United States Patent 7,415,358 (MOLECULAR TOXICOLOGY MODELING) - sequence listing, part 2

SEQ ID NO: 1924 - DNA, 3360 bp, Rattus norvegicus
  Genbank Accession No. NM_031614
gccttgcagcggcgcgggcaaacggagaggccgcgggaggcgcgaagccggcagaaggcgagggagagcggagggcggccatggtccagccctgaagccaaacaaaaaaggcctacttcgaaagctgtcaacaatgaatgactctaaagatgcccctaagtcctatgacttcgacctgatcatcattggaggaggctcgggaggcctggcggcagctaaggaggcagccaaatttgacaagaaggtgatggtcttggacttcgtcacaccaactcctctcggaacgaatgggggtctcgggggaacgtgtgtgaacgtgggctgcatacctaaaaaactgatgcaccaggcggctctgttaggacaagctctgaaagactcacgcaactatggctggaaactcgaggacacagttaagcatgactgggagaaaatgacagaatctgtgcagaatcatatcggctcgctgaactggggctaccgagtagctctccgggagaagaaggtcgtctatgagaatgcttacgggaaattcattggtcctcacaaaattatggcaacaaataacaaaggtaaagaaaaagtttactcagcagagcggttcctcattgccaccggtgaaaggccacgctacctgggcatccctggagacaaagagtactgcatcagcagtgacgatcttttctccttgccttactgcccggggaagaccctagtggttggcgcgtcctatgtcgccttggaatgtgcaggattcctggctggtatcggcctcgacgtcactgtaatggtgcggtccattctccttagaggatttgaccaggacatggccaacaaaattggtgaacacatggaagagcatggtatcaagtttatcaggcagttcgtgccgacgaaaattgaacagattgaagcagggacaccaggccgactcaaggtgaccgctaaatccacaaacagtgaggagaccatagaagacgaatttaacacagtgttgcttgcagtaggaagagattcttgtacaagaactattggcttagagaccgtgggcgtgaagatcaatgaaaagaccgggaagatacctgtcacggatgaggagcagaccaatgtgccttacatctacgccattggtgacattctggaggggaagctggagctgacccccgtggccatccaggcggggagattgctggctcagaggctgtatggcggctccactgtcaaatgtgactatgacaatgtcccaacgactgtgtttactcctttggagtatggctgctgtggcctctctgaagaaaaagctgtagagaaatttggggaagaaaatattgaagtttatcacagtttcttctggccattggaatggacagttccatcccgggataacaacaaatgttatgcaaaagtcatctgtaaccttaaagacaacgaacgtgtcgtgggcttccacgtactgggtccaaatgctggagaggtgacgcaggctttgcagccactcaagtgcgggctgaccaagcagcagctggacagcaccattggcatccacccggtctgtgcagagatatttacaacgctgtcggtgactaagcgttctgggggagacatcctccagtctggctgctgaggttaagccccagtgtggatgctgttgccaagactacagaccattgcttgcttccttgtccacacccaggtgaagttcaggaaggctcttgggttcttggcaccaattcaaggtgctatcctaaggccaccaggtccctgggatcttgtgggtaggaggtggcaggtagaagaaggctgcagcatcgcactggggtcaccatgacggactcagactgacattcggcagagcatcacggtgcgtccatgaagtcactagcctcaagcccaagtggtgggcagtgacagaaagctgtcgatctgttgggttcaacctttccctgtagactgttttagtctcgccttcaagctatgtaatgtcaattctgttttttcttttctccatggggttaatgatactagaggtagggaatgttagcaatcagtttttgtcatggctggactatccacagcacggtcgttactgtgtggaagggggtcagatggcttatgagagccaaaccagtttatcctgagaaagacgaattaccctgtggctaaaatacactgtttttactaacctgtgtagcattgtcccctttaataagtttaggtcttctgtccaaactgagaaaaaccatggtcactttggcaaatttccggcagtgtgtgtccctgccgctgcttagcaagggcggcggtgacttggctaatctactcagactcattgcatggctcttgggtatcatggagtattccagcatagagcctgaccagcagtaaatgtctctcctggtacagttactgtctgctggactaagtgcgctgagatggttctcaatggagaatgcttaatttgcttttaacctcttgtttttgtgaggtgggtttagttttaagcttatgtcccataagaactccattcacaggcaagcagctctttccgcacacagcatatgcatcttctgaggtaatggctttataaggaagctgttcataacataagttattattattattgaacacaggtggatgtgaaggattttttttcattgaagaaccaaatggtttttcttttttctgttcagtgagcccacagagaccctggcaggaacagcattgctggcagcattgctgctgggcttttccagtgtagttcttgctcctaggtcacgtgacagcgaacacgatgcctgaggaccgcgcagacaggtttcccaccgcacagccgcccaaggtcccgccatggtccggtagctccttttcttgtcctcccctctgcccatctccacctgcagtactgagtggcgtttcccagtaccctttggggccacctcagggaacgggtttgcctggtattcagccagcggcacccaccctgccccacgaggctccctcagatccgccccacatccgtgtgttgaagaggagaaaggaccagggaaccaaaggagtggactgttgagttttatttatttattttttgtttttttttctcctaagtctgccagtctctgagatcagaacgacagtgtagggtagccgcctaatcatgttgtgattctattggtgggatgaaatgttccgcccccatggaaggagtacactcgtcgtttatgttctgtaatcgcacaatgtactgtaacccaaattccaattccatgtatttttattacagtttctctgggaaaaaaaaatgtgaaacaataaaaaggtgttgattcacgaaaaaaaaaaaaaaaaaaaaaaaaaaaaaaa

SEQ ID NO: 1925 - DNA, 1723 bp, Rattus norvegicus
  Genbank Accession No. NM_031627
taatgtccagggctccaggaagagatgtccttgtggctggaggccgcagtgcctgatgtttctcctgactctgcaacggagttgtggaagacagaacctcaagatgcaggagaccagggaggcaacacttgcatccttagggaggaagccaggatgccccaatcaactgggggtgctttaaggatagggttggagtcatccgagcctacagccctgctccccagggcagagaccctcccagagcctacagaacttcgtccacagaagcggaaaaaggggccagcccccaaaatgctggggaacgagctatgcagtgtatgtggggacaaggcctctgcgttccattacaatgtgctgagctgcgagggctgcaagggattcttccgccgcagtgtcatcaagggagcacgctacatttgccatagcggtggccactgccccatggacacctacatgcggcggaaatgccaggagtgtcgccttcgcaaatgccgccacgcaggcatgagggaggagtgtgtcttatcagaagaacagatccgcttgaagaaactgaagcgtcaagaagaggagcaggctcaagccacatcggtgtccccaagggtttcctcaccgccccaggtcctgccacagctcagcccagaacaactgggcatgattgagaagttggtggctgcccagcaacagtgtaacaggcgctccttctctgaccgacttcgagtcacgccttggcccattgcacccgaccctcagagccgggaagcccgccaacagcgctttgcccactttactgagctggccatcgtgtccgtgcaggagattgttgactttgccaaacagctccctggcttcctacagctgagcagggaggaccagatcgccttgctgaagacctctgcgatcgaggtgatgcttctggagacatcgcggaggtacaaccctgggagtgagagcatcaccttcctcaaggatttcagttacaaccgggaagactttgccaaagcagggctgcaggtggagttcattaaccccatctttgagttctccagatccatgaatgaactgcaactcaatgatgctgaatttgctctgctcatagccatcagcatcttctctgcagaccggcccaacgtgcaggaccagctccaagtagagagactgcaacacacatatgtggaggccctgcatgcctatgtctccatcaaccacccccacgaccgactgatgttcccacggatgctaatgaagctggtgagcctccggactttgagcagcgtccattcagagcaagtgtttgcacttcgcctgcaggacaaaaaacttccccctctgctctccgagatctgggatgtccacgaatgactgtttctccgtgtcctctgtgttggccacgcagctgaagcttactgactgcttcctagaggtggagcagactgaggagggcaaacattcctgggcgctgggtgaaagagacccttgcatggcactaaagagagtcaaagggttgggtgttttgtggctgctgggcagttggggacctactaacgttgtatgccatctgaaggccttgttgacccaaccaaataaactagccaggagagccactttgtgcagggttcttcaggccctgcccaaaaaaaaaaaaaaaaaacgactaacgttgtatgccatctgaaggccttgttgacccaaccaaataaactagccaggagagccactttgt

SEQ ID NO: 1926 - DNA, 1356 bp, Rattus norvegicus
  Genbank Accession No. NM_031642
ggagactgtcttttccaacccgacatggatgtgctcccaatgtgtagcatcttccaggaactacagattgtgcacgaaacgggctacttctcggctctgccgtccctggaggaatattggcaacagacctgcctggagttggaacgctatcttcagagtgagccctgctacgtgtcagcctctgagataaaatttgacaaccaggaagacctgtggaccaaaatcattctagcacgggagaggaaggaggaatcagaactgaagatttcttctagtcccccagaggactctctgatcagctccggctttaattataacttagagaccaatagcctgaactctgatgtcagcagcgaatcttcagacagttcggaggaactttcgcccacgaccaagtttacctctgaccccattggtgaagtcttagtcaattcaggaaatctgagttcctcggtcatttccacacctccttcttctcccgaagtaaatagggaatcttctcaactatggggctgtgggccaggagacctgccctcacctgggaaggttcgaagtgggacctcggggaagtctggcgacaagggtagtggcgacgcctccccagatggcagaagaagggtacatcggtgccattttaacggctgcaggaaagtttacactaaaagctcccacttgaaagcacatcagcgcactcacacaggagaaaagccttacagatgctcttgggaaggttgtgagtggcgttttgcaagaagtgatgagttgaccagacacttccgaaagcatactggtgccaagccctttaaatgctctcactgtgacaggtgtttctccaggtctgaccacctggccctgcacatgaagaggcatctctgagggagcagaggatgaatcctgtaggctaaaagaggcttccaggctaagaggcggccatggaaggagggatacctgtaccagccaaagcatgccattgcttcctacccagttacctccagaggcctctctttggaaggtcttttgagggctacaaaagtcatgtcagaagcggcatagcacccacggtgcatggtgtttgggtgaccccggactcaccactggtttctaaccttctgagaggctctaagcttttcgccgtgagcatgcgcactgagaatgttaatgggtgggaatgactgactgtatgttgaggatctattactgactgtatggcgaggcagactttttttttccccccttgtggtagcaaatacctgcaagagacagaaaaaaaaagcagtttgaatgttttgtgtgtgaggagtattccaagggatgagttgaccaccaatcatttcctgaagggtgtctgcaccttag

SEQ ID NO: 1927 - DNA, 1182 bp, Rattus norvegicus
  Genbank Accession No. NM_031643
atgcccaagaagaagccgacgcccatccagctgaacccggcccccgatggctccgcggttaacgggaccagctcggccgagaccaacctggaggccttgcagaagaagctggaggagctggagctggacgagcagcagcggaagcgccttgaggcctttctgacgcagaagcagaaggtgggagagttgaaggatgatgactttgagaagatcagtgaactgggggctggcaatggtggagtggtgttcaaggtctcccacaagccatctggcctggttatggctaggaagctaattcacctggagatcaaacccgcaatccggaaccagatcatccgggagctgcaggtgctgcatgagtgcaactccccgtacatagtgggcttctacggggccttctacagtgacggcgagatcagcatctgcatggagcacatggatggtgggtccttggatcaagtgctgaagaaagctggaagaattcctgagcaaattttaggaaaagtcagcatcgctgtgataaaaggcctgacatatctacgagagaagcacaagattatgcacagagatgtcaagccttccaacattctagtgaactcacgtggggagatcaaactctgcgattttggggtcagcgggcagctaattgactccatggccaactccttcgtgggaacaaggtcctacatgtcgcctgagagactccaggggactcactactctgtgcagtcggacatctggagcatggggctctctctggtggagatggcagttggaagataccccattcctcctcctgatgccaaggagctggagctgctgtttggatgccaggtggaaggagacgcggccgaaacgccacccaggccaaggacccctgggaggcccctcagctcatatggaatggatagccgacctcccatggcaatttttgagttgttggattacatcgtcaatgagcctcctccaaaactgcccagtggagtattcagtctggaatttcaggattttgtgaataagtgcttaataaagaaccctgcagagagagcagatctgaagcagctcatggtacatgctttcatcaagagatctgatgccgaggaggtagacttcgcaggctggctctgctccaccattgggcttaaccagcccagcacaccaacccacgctgccagcatctga

SEQ ID NO: 1928 - DNA, 5191 bp, Rattus norvegicus
  Genbank Accession No. NM_031653
aacaccggagccaggcgtcgcgtcctttgtgcccggaaccgtggggatgtgtccgcgctaaggagccagctccagtatgggggccgaatctgtctgggcctcaggcctcctggtgctgtggctgcttctcctagtgtctggggatcaggacacacaggacaccaccaccacggaaaaggggcttcacatgctgaagtcggggtcaggacccatccaggctgctttggcagagttagtggccctgccctgcttctttacccttcaaccacggcaaagccccctgggagacattcctcggatcaagtggacgaaagttcagactgcatcaggccagcgacaggatttgccaatcttggtggccaaagacaatgtggtgcgtgtggccaagggctggcagggacgggtgtcattgcctgcctatccccggcacagagccaatgctacacttctgttggggccactgcgagccagtgactctgggctgtatcgctgccaagtggtgaagggtatcgaggatgagcaggacctggtaaccctggaagtgacgggcgtcgtgttccattatcgggcggcccgggaccgctatgcgttgaccttcgctgaggcccaggaggcttgtcacctgagctccgctaccattgcggctccaaggcacctgcaggctgcgttcgaagatggctttgacaactgcgatgcgggctggctctcagaccgcacggtccggtacccgatcactcagtcgcgtcccggttgctatggtgatcgcagcagcctgccaggtgtccggagctacgggagacgcgacccgcaggaactctacgatgtctactgctttgcccgcgagctagggggtgaagtcttttacgtgggccccgcccgccgactgaccctggcgggggcgcgggcactgtgtcagcgtcagggtgcagcgctggcctccgtgggacagttgcacctggcctggcacgagggcctggaccagtgcgacccgggctggctggcagacggcagcgtgcgctacccgatccagactccacggcggcgttgcgggggctccgctccaggtgtgcgcacagtgtaccgcttcgccaaccgcactggctttcctgcgccaggagcccgcttcgacgcctactgcttccgagctcatcaccatacaccacaacgtggggactccgagatcccctcatctggagatgagggggagattgtgtcagcagaggggccgccagccccagaactaaagcccagattgggggagcaggaggtgataacacctgacttccaggaacctctcgtatccagtggagaagatgaacccctagatttgacaaggacacaagcatctcaggagacgctcgcctctaccccagggggtcccacactggcttcatggctgcttacaggtgtcacaagctccacgggtgtccccagccccagcagcctgggagtagacatggaagagacaacaccctcaggcacacaggtagcccccacccccacaatgaggaggggccgctttaaagggttgaatggtcgacacttccagcaacagggcccagaagaccagcttctggaggcagcagaggccagtgcccagcctcccaccctggaagttactgctgaccacatggggccttctgcagccacagaggccttggagagtgaccagagccacagtccttgggccattctgaccaatgaagtggatgtgccaggggcaggctctcttggcagcaggagtctcccagagtcccggaagtggtccccgtcgctgatttcacccagtactgtcccgagcactgacagtactcctggcctgaagccaggggcagatgaggcccctggtgtgaagtcagccatccaccacccaccctggttgccctcagaacccgctgtcccatcctccattccctcagaggccctaagtgctgtctccctacaggcatcccctggtgatggctctccagacttccccattgtagccatgcttcgagcccccaaactgtggcttctgccacactctacactcgtcccgaatgtgtccccaatcccactctccccagcttctccactcccctcctcggtcccagaagaacaggctgtcagacctgtcagctttggagcagaagaccccgagaccccatttcagaccaccatggctgccccaggtgaagccagccacggatcccctgaggcagactccatagaaatcgaggggatcagctccatgcaggctacaaagcaccccatctctggcccatgggcttctttggactccagtaatgtgacagtgaatcctgtcccttctgatgctggcatcctagggactgagtctggggtcttggacttaccagggagtcccacatcagacggacaggccactgtggacatggtgctggccacctggctaccactgcctggccacggactggacactggctcccagtccacacccatggaagcccatggagtaaccatgagtgtggaacctacagtggctttggaaggaggtgccaccaaagacccaatggaggccaccatggatgtggtccccagcactgttgatgccacttcggggtctgaacccaaaagttccatttctagcacccatgtggttgtgactgcagctggggaccagggcacacccacactgacccctacaagctctgaaggtcaggtggtggcccaggagtcactgggaaccctcaccagtctgccttctcatccctggtcatctctggcctccagcatggacgaagtggcctcggtttcctcaggagaacccacaaggttgtgggacatccccagcactctgatacctgtgtccttgggcttggatgaatcagacctgaaggttgtggctgagagcccaggcttggagggcttctgggaagaggtggccagtgggcaggaagaccccacggatccctgcgagaacaacccttgtctgcacgggggcacctgccgcacaaatggcaccatgtacggctgtagttgtgatcagggctatgctggggagaattgtgaaattgacattgatgactgcttgtgcagcccttgtgagaatgggggtacctgcattgatgaggtgaatggtttcatctgcctctgtctccccagctatgggggcaacctgtgcgagaaggacacagaaggatgcgaccgtggctggcacaaattccagggccactgctaccgctactttgctcatcggcgggcctgggaggacgcagagagagactgcaggcgccgagccggccacctgacaagtgtccactccccagaagagcacaagtttattaacagttttggacacgagaattcatggattggcctgaatgacaggacagtagagagggacttccagtggacagacaacacaggactgcaatatgagaactggagagagaagcagccggataatttcttcgcaggtggggaggattgtgtggtgatggtggcgcatgagaatggacgctggaatgatgtcccctgtaactacaacctcccctacgtctgcaagaagggtacagtgctgtgtgggccccctccagcagtggagaatgcctctcttgttggtgtgcgcaaggtcaagtacaatgtccatgccactgtgcgataccagtgtgatgaaggattctcccagcaccatgtggctaccatccgatgccgaagcaatgggaagtgggaccggcctcagattgtgtgcaccaagcccaggcggtcacatcggatgcgtcgacaccaccaccatccacaccggcatcacaagccacgcaaggagcacagaaaacacaagagacacccagcggaagactgggagaaagatgaaggggatttctgctaacgatccagactaatcaagcacaagctcccacacctcctccagagcattcccctggggacccagaacccagacaaccaccagagagagggtggggacaccctggagccccacacccctgcagtcggtcctctgtacaaagctcagatcaccctctccttccttactgaggtcctcctggcaggggtggcgggacctgagaggccattctggtctggctgagcccttaggattacttcccagctgtcaaagggagtctcgaagtctgtatccatgaggggcaaacagtatgtctgtgggcgctgggtagtgactttcacaccagagattcaggcttcgtaaacagcggactatactgaatccatggcaaacctttggttaaagtcactgtatttgagtggaggaccagcagagcaaacaggatgctctgtggtcccctgggatcccctaagggcaggcttccatccctccgtctttcttttttccctttctccttcctccctctcaattccaacactgtcaggactcaacctaggctgggcttgaactgactattgtagaaggatgtccttgaagtctcaatcctcctgcccctgtgccaccatgcctacctggtttatttggtgctggacatggaacccagcgctgggcaagtgctctctctactaaccagctctggtctttggtcttggtgcagaccactaaatctagtgtgggaactcttgtatattgaattttagtgatgtctcttagcctggcctccgtggcttcctaggggaggttcctcagagcaatgggggtggggagggttactctattgctgactccccacgtctagtgcagcgctgagatctggtggttctattttgggttgtttttgttttgagacagggcctcactgtgcagctctagctggcctggaacttgctatgtagaccaggctagcctggaactcagcgatctgtctgcctctgcctctctagttactatgcccagccttcttttgttttactgacctaggatctctatagcccaggctgggtttcagtccacagcgatcagatcctttctcaaccacctaagagctgaggtgacaggcacaccatcacgtgtggcacttttgtgggtgtgtgatggcaaatctcccacacccatgtgtccagacgtgagacagcagagtagagtgtactggatgctgctgtatccctctcctccatctctcagggagacagacaaccttctgcccggaccaagatgctgccatgttttctaacccagagcctgtctttactaaaaccctctcagcagacctcagtaaatctcctgcctcagatcccggaattc

SEQ ID NO: 1929 - DNA, 1087 bp, Rattus norvegicus
  Genbank Accession No. NM_031655
ggaagagggaagaaggcgctgaggaccgcgcacgcccagcccagctgctgacttcaccacctcaccgagacccactccgctggccagcacgctacactgacaggatcctggctgcacccactgtgatctctttgaactaggatagcccgcgctcactgtttccctgaagatggaagaaatcccacccacccactacgctgcgtccagggctgcctcggtggcagagaactgtataaattatcagcaagggacccccaacaaggtattcaaggtgcagacggtccagcaggcaagcaaggaggatatcccaggaagaggccacaagtaccatctgaagttttctgtggaagaaattatccaaaaacaagttacagtgagctgcacggctgaagttctttaccctcgaatgggacaaggctctgcaccggaagtcaacttcacatttgaaggagaaatcggcaagaacccagatgaggaagacaacacgttttatcaaagactcatgtccatgaaggaaccactacaagcacaaaatattccagacaattttggaaatgtgtctccacaaatgaagccggtccaccacttagcctgggtcgcctgtggttatgtaatgtggcagaactcgactgaagacacatggtataaaatggcaaagattcaaacggtcaagcaagtgcaaagaaacgatgacttcattgagttagactacaccgtcctactccacgacgttgcatcgcaggagattatcccctggcaaatgcaagttctgtggcacccacaatacggcacaaaagtaaagcacaacagccgcctcccaaaggaagcaccagcagagtaaacaagaccccaactcggagacagccgtcaacatgccccttaaccatgagtatgactgtcctcactggcacctagctaacaggccaagtgaatcccacagtgtcgctctgtatgtcttggctacaggaccgagctgcatagattccacaataaagagtagactacatgaaagtgtctttccaatagtaatggtactatggctatccactaataaagtcaacttcagcctcacaaaaaaaaaaaaaaa

SEQ ID NO: 1930 - DNA, 339 bp, Rattus norvegicus
  Genbank Accession No. NM_031660
atgtctgcggaagtccccgaggcagcgtcggcggaggagcaaaaagaaatggaagataaagtaactagtccagagaaagctgaagaagcaaagttaaaagcaaggtatcctcatttgggacaaaagcctggtggttctgactttttaaggaaaagattgcagaaagggcaaaagtattttgattctggggattacaacatggcaaaagcaaagatgaagaacaagcagcttcctgctgcagccccggataagacagaggtcactggtgaccacattcccactccacaggaccttcctcagcggaaaccatcccttgttgctagcaaactggctggctga

SEQ ID NO: 1931 - DNA, 3923 bp, Rattus norvegicus
  Genbank Accession No. NM_031672
ctgaggctggcagctactgaaactgacacacacagggttaaacctatttgctgtggccatccctcctccccctagtcccccttttcactgtaggctggcagcagtcctaactgcctactgaagccaaatgcttgaggagagagagagtaaggagccagccatgaatcctttccagaaaaatgagtccaaggaaacgcttttttcacctgtctctactgaggagatgctgcctagacctccgagccctccaaagaagtcacctccgaaaatctttggctccagctacccagtcagcattgccttcatcgtggtgaatgaattctgcgagcgattttcctattatggcatgaaagctgtgctgaccttgtacttcctgtatttcctgcactggaatgaagacacgtccacctctgtctaccatgccttcagcagcctctgctatttcactcccatcttgggtgcggccattgctgactcctggctgggaaaattcaagacaatcatctatctctccctggtgtatgttcttggccatgtattcaagtctttgggtgccataccaatactgggaggaaaaatgctacatacaatcttatcattggttggtctgagtctaattgctctgggaacaggaggtatcaaaccctgtgtggcagctttcggcggagaccagtttgaagaggaacatgcagaggcacggactagatacttctcagtcttctacctcgccatcaatgcggggagcttgatttccacgttcatcacacccatgctgagaggagatgtgaagtgttttggccaagactgctatgcactggcttttggagttccaggattgctcatggtgctggcacttgttgtgtttgcaatgggaagcaagatgtacaggaaaccacctcctgaagggaacatagtggctcaagttatcaaatgcatatggtttgctctctgcaaccgcttcaggaaccgttctggggaccttccgaagcgacaacactggctagactgggcagcagaaaaatatccaaagcatctcatcgcagatgtgaaggccctgaccagggtactgtttctttatatcccactgcccatgttctgggcacttttggaccaacagggctcgcggtggactctgcaagctaacaagatgaatggtgacttgggtttttttgtacttcagccggatcagatgcaggtgctaaatccctttctggttcttatcttcatccccttgtttgaccttgtcatttaccggctgatctccaagtgcagaattaacttctcatcactcaggaaaatggcagttggtatgatcctagcgtgcttggcttttgcagttgcagcacttgtcgagacaaaaataaatggaatgatccatccccagccagcttcccaagagatatttttacaagtcttgaatttggcagatggtgatgtaaaggtgaccgtgctgggcagtagaaataattctctcttggtggagtccgtcagctcttttcagaacacaacgcactattcaaaactacacctggaggcaaagagccaagatttacattttcatctgaagtataacagcttgtctgtccacaatgaccattctgtagaggagaagaactgttaccagctgctcattcaccaggacggggagagtatctccagcatgctggtcaaggatacaggaatcaaaccagccaatgggatggcagccatcaggtttattaacactttgcataaagacttgaacatctccttggatacagacgctcctctcagcgtgggcaaagactacggagtgtctgcatacagaactgtgctaagaggaaagtatcctgcagtgcactgtgaaactgaagacaaagtcttttctctcgatttaggtcaactagactttggtacaacatatttgttcgtgatcactaatatcaccagtcagggtcttcaggcctggaaggcagaggacattccagtcaataaactatccattgcatggcagctaccacagtatgtcctggttacagcagcagaggtcatgttctcagtcacaggacttgaattttcttattctcaggcaccatctagcatgaaatctgtgctccaggcggcctggttgttgaccgttgcagttgggaatatcattgtgcttgtcgtggctcagttcagtggcctggcacagtgggccgagttcgttttgttttcctgcctcctcctggtggtctgcctgatcttctccgtcatggcctactactacgttcctctaaagtcagaagatacccgtgaggcaacagataagcagattcctgccgtgcaggggaatatgattaacctagaaaccaagaatacaaggctctgatgacttgctgatggatacctgacccctggctctgatttcagccactgcttattttcaagcaacaaccattttcctcaggccaggttaggagaaggagacagcatctatctgaatggattgcctccagttccctaccacagtagaggcaattctaggactaagttttcagatacatctttaaacagggatccgagactccgtgccctacaggccgttgatcaacttggtaaacgtcaggtgatgtctctcaggctggcccagtatctccgagtgcccatgaaaaatacaaatgtgtagaagagataagtctcacgggtctgctaagtttgagggattcctttaccaggtatttggagcctatagctctacttgtcgatgtgttggttacagaatactggttttccaagtttctttatcagtcgtataacttcgctattcatgaggatgtcaaaaaacgttacatatagtatgacccaatccagaggctagcttgtcagctaggaagtctaacatgattttaatagatggcagactatagaatggcgttgtatctacacatggaagatacctcttttctgatttaccacagtggtttatcaacttacccaaccaggcttttctcagatcctgaaaaccacaattaaggacagtagtcagaatcgtggggacacgggggtgcacataaactattcattctcctgtactacaggatactaaagaactctcctgctcctggcctgggcgtgctcctctgtgaacatctgtctaagaaactaactataactttgcaacccaggcttttccgtggcgctgggacagcttatctttttcagtgcatcttattctgcgtattacagcaagtcttcaataacaaaatgttcttctaacccaacttcctgtaatttttttctatttagctcctttgttatgcatctttacttttcctgtaatttttgtttacatttctccctttgggcttagcagtttcttgtttattgaaaagggataatactaacatcctaggtctgaagcgctaaactgtgctagtcatcaaatggacaaggacctgcatgagaaacttattaaaaatctgtggcgaggtgggacaggtgcaggttttgtttgtgcgtgtgaacaaaaggagttgagaggcattgtctcacgtgtaataacgtgggtcaggggacgagtttgggatgtcaggactgtgtcatgtattcctaggagaaaacgttccctgcccctatatgaaagacctctcatttctgttccttttactacactgttcccttcaacggccatgttgaattgcacattattagtaatgtaatatattcttaagcgaatctgctccagttcgtcaagctttaaatacttcagtatttaagtaccgagatttcagaaagcataaaagaggtcacaataccatctactttcctcagatgacttaatgagaacctgtccagactcctttagaaggtgttcactttccagaagctttaactcaaactctttgatgaattttgttttaaaagatgttaacactgatctgtgaataaaattttttacatac

SEQ ID NO: 1932 - DNA, 917 bp, Rattus norvegicus
  Genbank Accession No. NM_031682
ggctcgtgcaagatggctgcggcgtgtcggagcgtgaagggcctggtggcagtaataaccggaggagcctcgggccttggcctgtctacagccaaaagactggtgggacaaggagccacagctgtacttctggacgtccctaactcagagggtgagaccgaagccaagaagttaggaggaaactgcatatttgccccagcaaatgtgacctctgagaaggaggtacaagcagctttgactctagcaaaagaaaagtttggccgtatagatgtggctgtcaactgtgcaggcattgcagtggccattaagacataccacgaaaagaagaaccaggtccacaccttggaggacttccagcgggttatcaatgtgaatctcataggcactttcaatgtgatccgcctggttgctggtgtgatgggccagaatgaaccagaccagggaggtcaacgtggagttatcattaacactgccagtgtggctgcttttgagggccaggttggacaagctgcatactctgcatccaaagggggcatagtgggcatgacactgcccattgctcgagatctggctcctataggcatccgtgtggtaacaattgctccaggtctgtttgccaccccactgcttaccactctgccagacaaagtgcgcaacttcttggccagccaggtacccttccccagccgactaggtgaccccgcggaatatgctcatctggtacagatggtaatcgagaacccattcttgaatggagaggtcatccggctggatggggccattcgaatgcagccttaaaaggccaaggcaggaaaaacaccggctccttttcagtttgaaggaaacctaacagccactttgtaactttgctccattcaccctctgtgcctaataaattctcaaatctgaaaaaaaaa

SEQ ID NO: 1933 - DNA, 683 bp, Rattus norvegicus
  Genbank Accession No. NM_031685
taggccggcatcatggagccactataccaacaaacgcacaagcaggtccacgagatccagtctcacatgggacgcctggagacggcagacaagcagtctgtgcacttagtggaaaatgaaatccaagcaagcatagaccagatattcagccacctggagcgtctggagattctgtcaagcaaggagccccccaatagaaggcagaacgccaaacttcgtgtcgaccagctaaagtacgacgtccagcacttgcagactgccctcaggaactttcagcaccggcgccaagccaaggagcagcaggagagacagcgagatgagcttctgtctcgcaccttcaccactaacgactctgacaccaccattcccatggatgaatcactgcagtttaactcctccctccagaacattcaccacggcatggatgacctcattggaggcgggcacagtattctggagggactgagggcccagagactgaccttgaaggggactcagaaaaagatcctcgacattgccaacatgctcggcttgtccaacaccgtgatgaggctgattgagaagcgggccttccaggacaagtacttcatgatcggtgggatgctgctcacttgtgcagttatgtttctcgtggtgcagtacctgacatgagccagctgtacccagcactggacagccttccc

SEQ ID NO: 1934 - DNA, 467 bp, Rattus norvegicus
  Genbank Accession No. NM_031687
  misc_feature (1)..(467): n = a or c or g or t
cggcagccaacatgcagatcttcgtgaagaccctgacgggcaagaccatcactcttgaggtcgagcccagtgacaccatcgagaatgtcaaggccaagatccaagacaaggaaggcatcccccctgaccagcagagactgatctttgctggcaaacagctggaggatggccgcaccctgtccgactacaacatccagaaagagtccaccttgcacctggtgctgcgtcttcgcggtggcatcatcgagccgtcccttcgtcagcttgcccagaagtacaactgtgacaagatgatctgccgcaagtgctacgcacgcctgcacccccgtgcagtcaactgccgcaagaagaagtgcggccacaccaacaacctgcgccccaagaagaaggtcaaatagagctgggcctatacctggcctgtgaccccgggaccaaataaagtccccttccatcgactggagcagtan

SEQ ID NO: 1935 - DNA, 1192 bp, Rattus norvegicus
  Genbank Accession No. NM_031700
ggaaaggagccgttagcgtgctccgtccattgccatccaccggtcgttcccggcgacagacctccgtcaacttttgaaggggagttggttctcaggtccagcggccgcgatccctggtctcccagcctacggagttacccggcggagttcaagtccagcagccatgtccatgagcctggagatcaccggcacgtcgctggccgtgctgggctggctgtgcaccatcgtgtgctgcgcccttcccatgtggcgcgtttcggcattcatcggcagcagcatcatcacggcgcagatcacctgggaaggcctgtggatgaactgcgtgcagagcaccggccagatgcagtgcaagatgtacgactcgctgctggccctgccgcaggacctccaggccgcccgagctctcatcgtggtgtctatcctactggcagccttcgggctcctcgtggcgctcgtgggggcccagtgtaccaactgcgtacaagatgagacggccaaggccaagatcaccatcgtggcgggagtgcttttcctgttggcggctgtgctcaccttagtgccggtgtcctggtccgccaacaccatcatccgggatttttataacccgctggtacctgaggcccagaagcgagagatgggaactgggttgtacgtgggctgggctgccgccgcgctgcaattgctagggggcgccttgctgtgttgctcctgcccaccacgcgagaagtacgcacccaccaagatcctctattccgcgccgcgatccaccggccctggcaccggtaccggcaccgcctatgaccgtaagactacgtctgagaggccgggtgcgcgcacaccgcaccatcaccactaccaaccgtcgatgtaccccacccgtccagcgtgcagcctcgcctcagagaccaccccaccttccagacggttacagacgccacgcagtctgcttgctaggctggaagaggacagacagcctggcgtccccttttctccggttgccacctgattacctggcctaggaactgtccaagtcgaatggacaaagacacctcgcccttcccaagtacagggttggggtggccatcgcagctacttgccagccccgcagccagaaggctcatagtgggcagagacaggcaaactataaaaagggccgtttcgtatttttcaataaaagcctttcgtttttgca

SEQ ID NO: 1936 - DNA, 2091 bp, Rattus norvegicus
  Genbank Accession No. NM_031705
attttcaagggccagcgagagagggagtttggcacagtttgtggagaactcaaagaaaaaccaactctgttcgcagtccccagctcctccagccatggcaccacaagaacgacttctcatccgcgggggtcgcgtggtcaatgatgacttctcacaggtggccgacgtgctagtggaggacggcgtggtgcgggcgctgggacgggacttgctgcctcccggggacacatcccgggggctgcggatcctagatgcagcgggcaagctcgtcctgccgggaggcatcgacacacacacgcacatgcagttcccgttcatgggctcgcagtcagtcgacgacttccaccagggcaccaaggctgctttggcaggaggcaccaccatgatcattgattttgcgattcctcagaaaggcagctccctcattgaagcttttgagacctggcgcaactgggcagaccccaaagtctgctgtgactatagcctgcacgtggcagtgacatggtggagtgacaaggtaaaagaagaaatgaaaacccttgcccaagataaaggcgttaactctttcaagatgtttatggcctacaaagacctgtacatggtgcaagaccagcaaatgtacgctgccttttctcagtgcaaggagataggggccattgctcaggtgcatgccgagaatggagatttgattgcagagggggccaagaagatgctggcactggggataacgggccccgaggggcacgagctgtgccgcccggaagcagtggaggcagaggccaccttgagagccatcaccattgctagcgctgtgaactgccctctatacatcgtgcacgtgatgagcaaatccgcagcgaaggtgatagctgatgcgaagagagaaggaaaggtggtctatggagaaccaattgcagcaggtctgggcacggatggcactcagtactggaataaagaatggcgccatgcagcccaccatgtcatgggtcccccactgagacctgatccatcaacgcctggctttctcatgaatctgttggctaatggcgatctgaccacaacagggagtgacaactgcactttcaacacctgccaaaaagctctagggaaggatgacttcactaagattcccaatggggtgaatggtgtcgaggacaggatgtcggtgatatgggaaaagggcgtgcacagtggcaaaatggatgaaaatagatttgtggcagttaccagcacaaatgcagccaaaatctttaatctttatccgaaaaaaggaagaatagctgtaggctcagatgctgacatggtgatctgggacccagaagccaccaggacgatctcagccaaaacacatcatcaggccgttaacttcaacattttcgagggcatggtttgccatggggtgcccctggtgactatttcaagaggcagagtggtgtatgaagcaggcgttttcgacgtcacagcaggacacgggaagtttattccgcgacaacctttcgctgagttcatttacaaacgagtcaagcagcgagaccagacctgcacacctataccggtgaagcgtgcgccctacaagggagaagtcatcacattgaaacccagagagacaaaagaagacgacacagctgggaccaggatgcagggccattcctgatttggatgctggggttaagcaagtgcaaacagagtgaaggctcccaggctcccctccccaccatgctgccaagccctggagaagcacctgccatttcaactctccaagatcctttaggaaaaattcatcgctctaggcctctttgatttttctctcagaagcaatagcagcctgcctcaccctgcctttgttgctgtggaagattgaggatataaatgaacattattgggatgaaacgtctgcatgaagattcattgaagattcctttttcaaatgccatctctccttaccctagatttctttctttgggtttttaaagatttccttctggtgtaaaggttttgtttgtttgttttgttttaatgtttatgtttgttttaaaaatcagtgattttacatttcattgcaactaataaacatctggagcttcattctgc

SEQ ID NO: 1937 - DNA, 696 bp, Rattus norvegicus
  Genbank Accession No. NM_031706
ctctttccagccagcgccgagcgatgggcatctctcgggacaactggcacaagcgccgcaagaccgggggtaagagaaaaccctaccacaagaagcggaagtatgagctgggacggccggccgccaacactaagattggccctcgccgcatacatacagtccgagttcgaggaggcaataagaagtatcgtgctctgagattggatgtggggaacttttcctggggctcagagtgttgtactcgcaaaacaaggatcattgatgttgtctacaatgcatccaataacgagcttgtccgcaccaagaccctggtgaagaactgcattgtgcttattgacagcacaccgtaccgacagtggtacgagtcccactatgcactgcccctgggccgcaagaagggggccaagctgactcctgaggaggaagagattttaaacaaaaaacgatcaaagaaaattcagaagaaatatgatgaaaggaaaaagaatgccaaaatcagcagtcttctggaggagcagttccagcagggcaagcttctcgcctgtattgcctcaagaccaggccagtgtggcagagcagatggctatgtgctcgaaggcaaggagctggagttctatctgcggaagatcaaagcccggaaaggcaaataaactgtcatagctcgtgtaataaaggtgtttgctgttctgtatatgt

SEQ ID NO: 1938 - DNA, 1444 bp, Rattus norvegicus
  Genbank Accession No. NM_031708
ccggcaggcgccgaggaggaagagcgagcccggacggtgcccctaggccgagtgtgagcgcggccaggatgacgacttcaggcgctctgttcccgagcctggttcccggctctcggggatcctctatcaagtatttggtggagttccgggcaggaaaaatgtcattaaaaggaactacggtcaccccagataaacggaaagggctcgtgtacatccagcagaccgacgattcccttattcacttctgttggaaagacaggacctctgggaccgtggaggatgacttgattatctttcctgatgactgtgagttcaagcgggtgcctcagtgccccagtgggagggtctacgtgctcaagtttaaggcagggtccaagcggctgttcttctggatgcaggagcccaagactgaccaagatgaggagcattgccggaaagtgaacgagtgtctgaacaacccccccatgcctgggacactgggagcgagtgggagtagtggccacgagctttcagcactgggcggtgagggtggcctgcagagtctgttggggaacatgagtcacagccagcttatgcagctcatcggaccagccggcctcggaggactgggtgggcttggggccctcactgggccaggcctggccagcttgctggggagcagtgggcctccagccagcagctcctcatccagctcccggagccagtcggcagccgtcaccccgtcctctaccacctcttccgctcgcgccaccccagccccttctgccccagcagctgcctcggcgaccagcccgagtcccgcacccagctcgggtaatggaaccagcacagcagccagcccgacccagcccatccagctgagcgacctccagagcattctggccactatgaacgtcccagcagggccaggaggcagccagcaggtggatctggcgagtgtgctgacaccagagatcatggctcccatccttgccaacgcagacgttcaggagcgcctgctgccctacctgccctctggggagtctctgccccagactgcagaggagatccagaacacattaacctcgccccagttccagcaggccctgggtatgttcagtgcggccttggcctcaggacagcttggccctctcatgtgccagtttggccttcctgcagaggctgtcgaggccgccaacaaaggtgatgtggaagcatttgccaaagccatgcagaataatgccaaatcagaccccaaggagggcgacacaaaagacaagaaagacgaagaggaagatatgagtctagattaaattattcgctgtccttccccagttggaattcgtagttgtgtgattccgtagtggtgattgtgatttgttcctggccgcctccccgccccaccccaccctacccacctcactaataaagtcctctcttgtacccgtcaaaaaaaaaaaaaaaa

SEQ ID NO: 1939 - DNA, 499 bp, Rattus norvegicus
  Genbank Accession No. NM_031709
tgttttcccctgccgccgccaagttccgcggagaagctccggggtgcgttcaagattcggcgtcacccgtaatccaccgccatggccgaggaaggcatagctgctggaggtgtaatggacgtcaacactgctctacaagaggtgctgaagaccgccctcatccacgatggcctagcacgtggcatacgcgaagctgccaaagccttagacaagcgccaagcccatctctgcgtgcttgcatccaactgtgatgagcccatgtatgtcaagctggtggaggcgctcttggccgagcaccagatcaacctgataaaggttgatgacaacaagaaactaggggaatgggtaggcctctgtaaaatcgatcgagaggggaagccacggaaagtggttggttgcagttgcgttgtagttaaggactatggcaaagaatctcaggccaaggatgtcatcgaggagtacttcaaatgctagaaatgaataaataaaattttggctc

SEQ ID NO: 1940 - DNA, 2005 bp, Rattus norvegicus
  Genbank Accession No. NM_031712
gtgagttccaagactagtagtgttcacagcagggagaatttctagtgacggagcggatccttctccacagaaatggcctccaccttcaaccccagagagtgtaaattgtccaaaaaagaggggcagaactatggcttcttcctccgcattgaaaaggacactgacggtcacctggtccgggtgattgaggaggggagcccggcagagaaggcagggctcctagacggcgacagagtgctcaggatcaacggggtctttgttgacaaggaagagcatgcacaggtggtggatctggtcagaaagagcgggaattcagtgaccctgctggttctggatggagactcctatgagaaggctgtaaaacatcaggtggacttgaaagaactggatcaaagcccaagggagccagctctgaatgaaaagaaacccgaccttgggatgaatggaggggtggagacgtgtgcccagccacggctctgctacctggtgaaggagggcaacagctttggcttctctctgaaaactatccaaggtaaaaagggcgtgttcctgactgatataacacctcagggcgtggccatgaaagctggtgttctggctgatgatcacttgattgaagtgaatggagaaaatgtagaaaacgccagtcatgaggaagtggtggaaaaggtgacaaagtcaggaagccgtatcatgttcctccttgtggacaaagaaactgccaggtgccatagtgagcagaaaacaccgttcaagagggagacagccagtttgaaactgctgccccaccagccccgggtagtagtgatcaagaagggcagcaatggctacggtttctatctgagggcgggccctgaacagaaaggtcaaatcatcaaggacatagaacctggaagcccagcagaggcagctggcttgaagaacaatgacttggtagttgctgtcaatggcgagtctgtggaagctcttgatcatgacagtgtggtggaaatgattagaaacggtggagaccagactactctgttggtgctggacaaggaggcagacagaatctatagcctggctcgtttctctccacttctctactgccaaagtcaagaactgcctaatggttctgtgaaggaagccccagctcccatctctgctcctctggaggccccaggctcagctaccacagaggacgtgggggatcataaacccaagctctgcaggctgattaaagaggacgacagctacggctttcacctgaacgccattcggggccagccaggctcctttgtcaaggaggtacagcagggtggccctgctgacaaggcagggctggagaatgaggacatcatcattgaagtgaatggggagaatgtgcaagatgaaccctatgacagagtggtggagagaatcaagagcagcggggagcacgtcactctgttggtctgtggaaaggtggcctacagctattttcaagctaagaaaatccccatcctttcttccttggctgaccccctggtggctggtcctgatgaaaaaggagagactgagcatgactcagcagagtccacgaaagactcctcccacccagcaagagaccgaactctcagcgcagcctcccactcttcttccaactctgaagacacggtgatgtgaagagaacaaacgacgtttcccctcatggtccgaggaaggagcccctcggaccctgccagacctcctcagaaccatcagtccctgaccgaaactgcggactgtctgtctgtctgtctgctgctgtaagggctgctactgcaggctgcttatttatgctcagcttagctggagggagggccgggttccggttctttctatgtggtatcttccaacgtgcaacttttcacttctgttgatgaaactttgatgaaacgtcttacttctgtgggcttgagcactgggatgattcatttgtgtcttgtgagtgatgatgattaaagtacccagcagacctttaaaaaaaaaaaaaaaaaaaaaaaaa

SEQ ID NO: 1941 - DNA, 2757 bp, Rattus norvegicus
  Genbank Accession No. NM_031715
gccagcgaggagagctaaaactacaagagtggatcatgacccatgaagagcatcatgaagccaaaaccctggggatcggcaaggccatcgccgtgttgacctctggtggagatgcccaaggtatgaatgctacggtcagggctgtggtacgagttggcatcttcaccgggctccgcgtcttctttgtccatgagggttaccaaggcctggtggatggtggagagcacatcagggaggccacctgggagagcgtgtccatgatgctccagctgggaggcacggtgattggaagtgcccgatgcaaggacttccgggagcgagaaggacgactccgagctgcccacaacctggtgaagcgggggatcaccaatctgtgtgtcatcggaggcgatggcagcctcactggggctgacacttttcgttcagagtggagtgacttattgaatgacctccagaaagatgggaagatcacagccgaggagcgtacaaagtccagctacctgaacatcgttttcctggttggctcaatcgacaatgacttctgtggcactgatatgaccattggtactgactctgccctgcaccgcattgtagagatcgtggacgccatcaccaccaccgctcagagccaccagaggacatttgtgttagaagtgatgggccgccactgtggatacctggcccttgtcacctctctgtcgtgtggggccgactgggttttcattcccgagtgtccgccagatgacgactgggaagaacacctttgtcgccgtctcagtgagacaagaacccgtggttctcgtctcaacatcatcattgttgctgagggtgcaatcgacaaaaacgggaagccaatcacctcagaagacatcaagaacctggtggtaaagcgtcttggatatgataccagggtcactgttctgggacatgtacagaggggtgggacaccatcagcctttgaccggatcctgggcagcaggatgggtgtggaagcagtgatggcacttttggaggggaccccagacaccccagcctgtgtggtgagcctctctggtaatacggctgtgcgcctgcccctcatggagtgtgtccaggtgaccaaagacgtgaccaaggctatggatgagaagagatttgatgaagccattaagctgagaggccggagcttcatgaacaactgggaggtatacaagcttctagctcatgtcagacccccagtctctaagggcgggttgcacacggtggctgtgatgaacgtgggggccccagctgctggaatgaatgctgcagttcgctctactgtgaggattggccttatccaaggcaaccgagtgctggtcgtgcatgatggctttgagggtctggccaaaggtcagattgaggaagctggctggagctatgttggaggctggactggtcaaggtggttccaaacttggtactaaaaggactctacccaagaagaacctggaacagatcagtgccaacataaccaagtataacatccagggcctggttatcattgggggctttgaggcttacacagggggcttggagctgatggagggcaggaagcagtttgatgagctctgcatcccatttgtggtcattcccgccacggtttccaataatgtcccagggtcagacttcagcatcggggctgacacagcactgaacaccatctgcacgacctgtgaccgaatcaagcagtctgcagcaggcaccaagcggcgagtgtttatcatcgagacgatgggtggttactgtggctatctggccaccatggcaggactggcggctggggctgatgctgcctacatttttgaggagcccttcaccatccgagatctccaggttaatgttgaacatctggtgcagaagatgaaaacaactgtgaagagaggcctggtgctgaggaatgagaagtgcaacgagaactacactactgatttcattttcaacctgtactctgaggaggggaagggcatcttcgacagcaggaagaacgtgcttggccacatgcagcagggtggaaacccaactccctttgacaggaattttgccaccaagatgggtgctaaggctacgaattggatgtctgggaaaatcaaagagagttaccgtaatggacggatctttgccaacactcccgactcaggttgtgttctggggatgcgtaagagggccctggtctttcagccagtgactgagctgaaggaccagacagattttgagcaccgaatccccaaagaacagtggtggctgaagctgaggccaatcctcaaaatcctggccaagtacgagattgatctggacacctctgaccacgcccacctggagcacatttccaggaagcggtctggagaagctgctgtctagaccactttggagtgaggggaaaatcacctgatcatggtcagctcacaccctggtagacctcagcccatggcttctcagtgttgtagcccagcccctacccttctaggtttccctgtactctgtacctgcaaccaggatcactgtggccaggtgttgggggaggggtggtgagtgcctctcctaggtagctgtccttccttgcaccctggcttcatctgtcacacaggctggatgtctctagtgctactgctagatttcagcttctcaagagtaaaagtgagctttatttatttctttgtgataacaaagagtcctaggtcctttccttgtaccacagtgaagtgtaactacactaataaaagccagctggccactgtga

SEQ ID NO: 1942 - DNA, 2977 bp, Rattus norvegicus
  Genbank Accession No. NM_031731
gaattcggcggatggaagccagctgtcccgagaagcagtgaactgtggcgtcatcccgagcagtgccttaccggtattgtgctgcttcacctgcctcgctcggcgttctcctcaggccccgccatggagcgacaggtccaacgacttcgccagacgttccggtccggccgatcgcggccgctgcgtttccgactgcagcagctcgaggccctccggaggatggtgcaagagcgagagaaggacatcttggcagccatcgcagcagacctgagcaaaagtgaactcaatgcatacagtcatgaagtcattaccatccttggggagattgacttcatgctggggaatcttcctgaattggcctctgctcggccagcgaagaagaacctgcttaccatgatggacgaggcctatgttcagccagagcctctgggagtcgtgctgattattggagcttggaactatccttttgttctgaccctgcagccactggtgggagccattgctgcaggaaatgctgccattgttaagccctcggaactcagtgaaaacacggctaagatcttggctgaactcctccctcagtatttagaccaggacctgtacatgattgttaatggcggcgttgaagaaaccacagagcttctgaggcagcggtttgatcacattctctacacaggaaacaccgcagttggaaaaattgtcatggaggctgctgccaagcacctgacccctgtgaccctggagctcgggggcaaaagcccatgctacattgacagagactgtgacctggacgttgcttgcagacggataacctggggaaagtacatgaattgtggtcagacctgtattgctcctgactatatcctgtgtgaagcctcctcccaggatcaaatcgtacagaagattaaggatacggtgaaggacttttatggggaaaatgtaaaagcttctcctgattatgaaaggatcatcaaccttcgtcactttaagaggataaaaagtttgcttgaaggacagaaaatagcttttggtggggagactgatgaagctacacgctacatagccccaaccatactcactgatgttgaccctaactccaaggtgatgcaagaagaaatttttggaccaattctcccaatagtgtctgtgaaaaatgtggaggaagccataaatttcataaatgatcgcgaaaagcccctggcactctacatattttctcacaacaataagctcatcaaacgggtgattgatgagacatccagtggtggagtcacaggcaatgatgtcatcatgcacttcactgttaattctttgccctttggaggtgtgggtgccagtggaatgggggcttatcatggcaaatacagtttcgataccttttctcatcagcgcccctgcttgttaaaagggttaaagggagagagtgttaacaaactcaggtaccctcccaacagcgagtccaaggtcagctggtcgaaattcttcctgctgaaacagttcaacaaaggaaggctgcagctgctgcttctcgtgtgcttggttgcggttgcagctgtgatcgtcaaggatcagctgtgatgacttccttgtagcctctactgaagtacccctcggccaaatggttaacacaccaatgcttttaaaattgtacccaaaccaggaaatgaaattcacaggtgaactgcagtcaaacctaagttgttgccacaaaccactgatgaaactcagtgcttcagccaaatcccagcatttgtcagccgtgcaggtgctgagagggtggagactgggaggggcgacacctagtccatggcagcgggatgtcagggagactcgacaactgctcccgcactctttgctccaggacatagctctcccacccggtgtcaacaccctccaggctttccagctgtcctctgattgctgaggttcctgttagggacccaggtactaaacctgggcgggtggatttgtcggcctcatccattgtggctcgagaccggccttcgggagtcggctctcagtctaaacatcctttctcattcatagtgtgtcacccgaagatgcttgtttgtgacattgtgacagtctgtcatgactgtcccggtgcctttgtgatgacttaaactacactgaggagcttgccaacttgtgaatgcccttcagagggtctggcagtcacagctgttccagagcccgagggacgaagattccggagcccggagtttgaggccaacctaggcaacataatgggaccctctcattattattcctccataacaatcccctcgagaccctcgatttgaatgttatataggtcttcaggataaatctgcttattttcacagcacaacacaaaaaaaatttacttttgaaatcttagagagattcctacagatcttagcatggagctgttcctgtagtgaaaggggggttattagacatgaggcttcagaactcatggggcagggttgttggagactaccgtgagctgagggggcacactgaagcgatgggatggccagaagcgcacctgagcaagcggggcagcattctctgtcagaccctaacatggctacacggggatgtggcagagagatctgtgccgttggctgccagcgctggttaggcctgaagctccaagctgcagaggtctcattgccttcccaggatccaaattaagactgcccactcaatgagaatgtcacttgcgtatgtacaaccatgtttgctgagtaacctgttccaccgttgaggctgtctgaagtgtattgtatgaggtatcaagaacgagtcattggcccatttggcaaatagttgcttatgtagcaattgtcatggactaatcataaaatattttgcacaaaatttcaatgttgaacttgcactcactgttgttaaattataaatcacagcttctagttaggccaaaatatttacatactctactaatcttcaaaataaatgtatcccggaattc

SEQ ID NO: 1943 - DNA, 5729 bp, Rattus norvegicus
  Genbank Accession No. NM_031740
agcctgcaggggtctcggggcgcacagggctgccgggattgtcctcgtgggtgtccgcagtccgagatcgccgcgtgtctgtcatctgtttccttcgtcctccgggccccggccgcgcgcatccgccgggtagtccggggtccgtgcggggggcggcggcgcctctccctcgggccgggcggcgggaatgcggttgccttggccggctgggcagcgggcgcggctgcaaacggaacccgggtgcactcgccgctggccgggacgccgccctggcctgctctcggctcccgaggccgccctgcgctctggggcccggcgcggaatgaggtgcaggccgcgcaccgccgacgccccctccgcggccccctggttcaacgcggccgcccgcgcctcgcgtgccccagcgcccacgttagagcctcgcactggcagcgctcgcggaggcacaggcctgcagagcgcacgccactcggcccgggtcccgatcgcggggactcgcctcttggacaccgccccaggtgcgggaccccgacacgctgcaagcgcgcgggccgcctccgcatcgcagagctcctctagcctggcccgtggctttggcctccacggagccggatctccctgcctccctccacatttctccgcatcctttcaacacccttcccgctgctctaccacctcccattcattgcatccatttctccttcccggctcggttcttcttcccataacctccccggccggaccccgctacccacccggtacattcatggaagtttagggcctggaccgtggctcggagtctggcctgagagcgcagcggagctgctggtagggcagaggaagatgtctgcgctcaagcggatgatgcgggtctccaatcgctccctgatcgccttcatcttcttcttctccctctccacgtcctgtctctatttcatctatgtggctccaggcatcgccaacacatacctctttatggtacaagctagaggcatcatgctgagagaaaatgtgaaaacaattggacacatgatcaggctgtataccaataaaaacactacgctcaatgggacagattatcccgaaggcaataatacaagtgactatcttgttcaaacaacaacgtatcttccgcagaacttcacgtattcaccgcacctcccctgtccagagaagctgccttatatgcggggattcctcagtgtcaacgtgagtgaaatcagctttgatgaagtccatcagctcttctccaaggactcggagattgagccgggaggccactggaggccccaggactgcaagcctagatggaaggtggcagttctcatccccttccgtaaccgccatgaacacctcccgatctttttcctgcacctgatcccgatgctccagaaacagaggctggaatttgccttttatgtcatcgaacagaccggcacacaaccgttcaatcgtgccatgctctttaacgtgggtttcaaagaggccatgaaggacagagcctgggactgtgtgatcttccacgacgtggatcatcttcctgagaacgatcggaactattacggatgcggggagatgccgcggcactttgcagcgaagctggacaagtacatgtacattcttccttataaggagttctttggtggggtgagtggcctgacagtggagcaatttaggaagatcaatggctttcccaatgccttctggggatggggaggagaggatgacgacctttggaacagagttcactactctggatacaatgtaacccggccagagggggacttgggaaaatatacatctattccccatcaccatcgaggggaagtacaatttttaggacggtataaattacttcgctattctaaggagcgtcagttcattgatggattgaacaatttattatacacacccaaaatactggttgacaggctgtatacaaatatatctgtaaacctcatgccggagttagctccagttgaagactattaaaaagaagtcattcccgtggtggggtagaccacagcactgaatcatgaacttggcttggaatgcactcaccgtggaagttagagattggtgtgtatctcagtgtcccagtctgtaaaaagaaccagcagtccttaatgtttacagcgtgggctccatctgtcacactccccactctcctccctgctgggagcacctcccatggcgagcactgtcgagatacaaacccattgcttgggattggaagtgaagaaaactccctacacagagaagattttttttatactgaaatctataatttaattcaagagaatgcttttatttccgttcaaacatattttgtacatatgtgatgtaaattaaatatgttcaaattgttggaaaataagatgtcataattttgcatgtaattggttatgccttcattggacttttatagacattttttttatttgcatggggggaaaaaactgtaaatttatgtcgccagacaaaggttaagccttgtgtgaaatgaagggactgtcagcgacggacaaagataataccgtaactgtttcgttgaactggtgttcagctttagccttcagcctcatgggaagaggcacagtcctctgagggctttgaaggaaggaaggaaggactcgaatagcttttcttcctgccaggattacctgttttgtttgtttgtttttttcacttgcttgcagtctcatcagatcttgccaagtcagcagccatattgtttatgcatactgcatgagtattaccaagaaaatcttcagagttgtaaagtgacatgctgtacaggacctcttcgtgttaaatgtctctatgtacctctgctgtgtcagggatcttgtgcctcaaaaaaaaaatgtccccaaggttgtgtttatacacggtctatatttttttcaatctcataatgaacagcattattatttccactttagaagaaccaaaagaaggtatcttcttttaaaaacattttttttaaagaatgaatttatggaaaatccagtagtgcttatacagatgaattatactattagatgagaaattagatgctctatttttatgaagataaatgcttagattaaaacagactttaactttaattctcaaacgtacatagttccctttcacatcagccagtcacttgaactgttttttttttctttttttccgctttcaagaaatctctggtgttattcaaatttttttttcactaccagtataatttaatgcccccccccccccccgtccccagtggagctgggaattgaatctagggcctgtagacttaccttaaaatcattattgtatgtgtggatgctgtgacttctgaactaggtctcacagcctaacgccaggtctgctcatcctcctcacttgggtgaggcttttgacaaccaaagaacaacaaagcccaaacagtgttctgaaaattatcaattctaaagattcttgaaaaatagcttgtattctcatgtaagatcttatctcccatatttaaacaaattgaaaacatcgcctatctgtcaagtgaaccctcccaaagagcaaagagtgagagaattctgaatgtggggaagtttgtccccttgtctgacgtgagagcttagcttgcagttgtccttgtctgtcacagttttaatgctgatggccacaagccaaagtaattagatccttacaccggagaagacagacaccctatctgttgtgacagcagtctttccaggttcttcttagacgtgcttctaaaatacttacctcccaacttttttggttactcaaagtagtggggggggggggaatcacaacctgtggaaatgaagatttttgtatgctatcagttattctctgtctcttgtggctaatgaggtgtttaattcgacggaatgacagtaaagtgtaatgttaatgttaaggctggtgagacaggactctgggtgtgtggtgagcccagccctggtccctcctcctggttctgtggaatgtggtaccacgtggattcttactgggggaaacacactttataaggtgacaggctatccacagtcagcaccttttgcattgatatatagttcacagctttaggaaaattcagaactggtgaactgccttactctcttagggtaagtctggcattaacatggctgcgggagtcggatgtatttctgctaaatcttcatgctgaatctgctgtgtcagcttgtgagaaccgccttttctaattcagacctggaattattttctttttctttttctttttttttttttttttttttggagctgaggactgaacccagggccttgagcttgctaggcaagagctctaccactgagctaaatcctcaaccccctggaattattttcagtagtgaatagtgatctctatatgtcaccacaaatgacagttttgccctgttaccataaccacagtgaatctcctccttctatattagcccaagcagacagtctgatagaatcaaatgcacttggtggctttgcactgtctgcccacatccgctgccttgccaacggtggtatttaaacgtggtttttgtttgcttttgcctgaacaagtcaaatcgagacagttgaaacttacctgagattaggaagaatgtcctctggtaacttacctgtcacttgtcttagactcggagccagtgtggccacagatgctgggaggccctcgtggcactggggaaatgatcgatgcctttgaactgaagaaagaaagcatgactgacaggccgaaagttcccacgtccactgtaacattctgtctgattttttaatgaagatgtcatttaattatttgccaaaactagggttttaatgaagtggcttccccagtcccctttttatagttattttctggtgtagacccttgaggtggctcagggtataaaggtgcctctcccaagcctgacaacctacgcttgatccctggggttcacactgtagaaggagaggactaccctggtacattgttctcagacttctgtatgtgtgcggctcgcgctcacacacacacacacacacacacacacacgcgcgcgcgcaaggcaaattaaaaggtatataaaagttaaatttctgttttataaaacggtgtttaataagaaaatatttataaaatttaagtacaaaattatctattaaaaattcctattcctgccagtcaatggtggagtttgcctttaatccaagctctctggaagcaaggcaggttctctgaattggaggccagcctggcctgtggagtgagttccaagacagctggggcgacacagagaaactgtctcaaaaacaaaaccaaatcaaaacaaaaactgctattccagttgatactgataaccattgtaaaagagagcagaaatatcatcaatacaatatcgtccctttgggactccctgggggggaagcagattgtatttgtgtcattgtatctgccctgtttctttataaataacactctagatttcttgccttgggtttgcagagttgttgagaagcaaactgtcgccgtgttttttggaaggtggaagtgtacttaagattatttattatgaaatggagtacttctatgtaagtgcgttgatgtaaacgctagtgatttctcgctttttttttttgtcttgttttgcttctcatggaaatgtttgtactttttttatcattgtcttttatgaaatacaatgttctaaagaaaaaaaaaaaaaaaa

SEQ ID NO: 1944 - DNA, 2169 bp, Rattus norvegicus
  Genbank Accession No. NM_031741
tgaggaggtgagccagctgcaggctacccttgcagagcaacgatggagaaagaggatcaagagaagacagggaagctgaccctggtccttgccctggcaactttcctagctgcctttggctcctccttccagtatgggtacaacgtggctgctgtcaactcgccctcagagttcatgcagcagttctacaatgacacctactacgacagaaacaaggagaacattgagtccttcaccctgacgctgctgtggtccctgactgtctccatgttcccctttggaggttttataggatctctcatggttggattcttggtgaataacttgggcagaaaaggggccttactgttcaacaacatattctccatcctgccggccatcttgatggggtgcagcaaaattgccaaatcctttgagataataattgcttccagacttctggttggaatatgtgcaggtatatcttccaacgtggtccccatgtacttaggggagctagcccccaaaaacctgcgaggggctcttggagtggttcctcagctcttcatcactgtgggcatccttgtggcccagctgtttggccttcggagtgtcttggcaagcgaggaaggctggccaatcctcctgggtctgactggagtccctgccggcctgcagctcctcttgctgcccttctttcctgagagcccccgctacctgctgattcagaagaaaaatgaatcagctgctgagaaagcccttcagacccttcgaggttggaaagatgtggacatggagatggaggaaatccggaaggaggatgaggctgagaaggcggcaggcttcatctctgtgtggaagctgttccgcatgcagtccctccgctggcaactcatctccacgatcgtcctcatgaccggccagcagctgtcaggagtgaacgcgatttactactacgctgaccagatctacctcagcgcaggggtgaaaagcaacgacgtccaatatgtgacggctgggactggggccgtcaacgtgttcatgaccatggtcacggtttttgtggtagagctttggggacgtcggaatcttctcctcatcggcttctccacctgcctcacagcttgcatagtgctgacggtcgcactggcactgcagaacaccatctcctggatgccctatgtcagcatcgtctgtgtcattgtctacgtcataggacacgccgtggggcccagtcccatccctgccctgttcatcaccgagatcttcctgcaatcctctcgaccatccgcctacatgatcggaggcagcgtccactggctctctaacttcatcgtgggcctcatcttcccgttcattcaagtgggccttggtccttacagcttcatcatctttgcgattatatgtctcctcacctccatctacatcttcatggtcgtcccagagaccaagggcaggacgtttgtcgagatcaaccagatttttgccaagaagaacaaggtatcggacgtatatccggagaaggaggaaaaggagcttaatgacctcccacctgctacccgggagcagtagcagagccaggccaccaggcagtatggccagtctgcatgggcctcctgtctagactttggttctgggttcttagtgtctgtgacactgggagggacacgagcctggcggggaatggcagccctccactcagtggggacacctgacgggctttcgtgcttccgtgctgtccctaaccatagaggccagtcacgggctcttggtcacacacaaagccatacctggcctttgctgggttgactgtggcgagggtcttgtaacattgcttttctaacaaaaacagttgccgagagacaagacgtgacggtcctattttttttttaactttttttttctattcttttttttttttttttttcggagctggggattgaacccagggccttgcgcttgctaggcaagcgctctaccactgagccaaatcccttgtgtggctcctcccatgggcgtggagagaccactggcatctgctggtgattgatgtggtcctctttttctgacccagccatgtcacaaagctgaggaacaggccacttggggagacacacggagcgtgaattatcaactgtcaacgacagtattctgtttagccaataaaacagatctgatcacttcttaaaa

SEQ ID NO: 1945 - DNA, 2866 bp, Rattus norvegicus
  Genbank Accession No. NM_031753
gtggaggaaagttgcgtgtggcacagacccgacggcgcagcgccacagcgaccgggggatcgtgtgtcttggaaaaaaaagtcgctgtccccctaagcgagacccacaagcgagcgggccccgtgggcccggggacgacgccccctctgcggcgtggactttgtcggtggccttctaggaggaggaatatggcatctaaagggtccccttcttgccgtctggttttctgcctcttgatctccgccgcggtcctcagaccaggcctcggatggtacactgtcaactcagcatacggagataccattgtcatgccttgcagactggatgtacctcagaacctcatgtttggcaaatggaaatatgaaaagcctgatgggtccccagtatttattgcattcagatcttctacaaagaaaagtgtgcagtatgatgatgtaccagagtacaaggacagactgagcctctcagaaaactacactctgtctatcaacaatgcaaagatcagtgacgaaaagagatttgtgtgcatgctagtgaccgaggacaacgtgtttgaggcacctaccctggtcaaggtgttcaagcaaccatctaaacctgaaattgtaaacagagcagcgtttcttgaaacagagcagctaaaaaagttaggtgactgcatttcaagagacagttacccagacggcaacatcacgtggtataggaatgggaaagtgctacagcctgttgatggagaggtgtccatactttttaaaaaggaaattgatccaggtactcagttgtataccatgacttcctccttggagtacaagacaaccaagtctgacatacaaatgccattcacctgttctgtgacatattatggaccttcgggccagaaaacaatttattctgaacaagcaatctttgatatttactatcctacagagcaggtgacaatacaagtactgccaccaaaaaatgccatcaaagaaggggacaacatcacccttcagtgcttggggaatggcaacccacctcctgaggagttcatgttttacttaccagggcaggctgaaggcataagaagctcaaacacttacacactgacagacgtgagacgcaatgccaccggggactacaaatgttctctcatcgaccaaagaaacatggcagcttcaacaaccatcactgttcactacttggatttatccttaaacccaagtggggaagtgaccaagcagatcggtgataccctgcctgtgtcttgcacaatatctgcaagtaggaatgcaactgtggtgtggatgaaggataacatcaggctccgatctagtccatccttttctagtcttcattatcaggatgctgggaactatgtctgtgaaactgctcttcaggaggttgagggactgaagaaaagggagtcgctgaccctcatcgtagaaggaaaacctcaaatcaaaatgacaaagaaaactgatcccagtggactgtctaagactataatctgccatgtggaagggtttccaaagccagctatacagtggaccattaccggcagtggaagcgtcataaaccaaacagaggagtctccttatattaatggcaggtattatagtaaaattatcatttcccctgaggagaatgttacattaacttgcacagcagaaaaccaactggagagaacagtaaactccctgaatgtctctgcgataagtattccagaacacgatgaggcagacgatataagtgatgaaaacagagaaaaggtgaatgaccaggccaaactaattgtgggcattgtggttggtctcctcctcgccgccctcgtcgccggtgtcgtctactggctgtacatgaagaaatcgaaaactgcatcaaaacatgtaaacaaggaccttggtaatatggaggagaataaaaagctagaagaaaacaatcacaaaacagaagcctaagagaggagttgtttagatgtcctgagaaaaaaacatataaagaaattgaagcatgaacgtgattgtatttaagacatatacaaagacaatgacagcaattcatggttcaagtattaagatgttcatcctactaagctgtcctgggatcttagagaattatctcaagtaaaacaatgaaataaagttataaaattacaacaagatttggcagccatgataataggtcatatgttgtatttcgtttgattttccttttctgtaaatgtctgcactgaggatttctttcagtttgccttttatgtaaattttttacgtagctatttttatacactgtaagctttgttctgggagtggctgttaattggatgtacaatgtaatgtttatttcaattgtttatatggatagtctgagcaggtgcggttctgattctgattgctatcagtaatgccccaaactttcttgtgaggatctgaaacccaaaggtggcagttatgagattgggacatggatcttgcccaatcagaagctggttttttttttaaaaaaaaaaacctggagagtcaggagcaccataagatatgatggtctctatgtgccaacgggttccccgaagcgggtcacaaacacatacggcaacaccacatgtgaatgatacttttaaactgacaatttcgtcttctctgaaaaaagacatacacagagtttgtataacactttacttaacgacacttgctagaaaattacattctgtttttaaaaaaaataaggaaaatgtaaagaagaatatctaatatgtcagagaaagttggaaacaaatcacagctcgcatccccatagtcgcagatcacgatgtaaatcactgtaattaaaattggtgttaaatcctttgggttatccactgccttaaaatgacacttatttcctt

SEQ ID NO: 1946 - DNA, 1233 bp, Rattus norvegicus
  Genbank Accession No. NM_031763
atggtgctgtcccagagacaacgagatgaactaaatcgagctatagcagattatcttcgttcaaatggctatgaagaggcatattccgtttttaaaaaggaagctgaactagatatgaatgaagaattagataagaagtatgctggtcttttggaaaaaaaatggacatctgttattagattacaaaaaaaggtaatggaattagaatcaaaactaaatgaagcaaaagaagaatttacgtcaggtggtcctcttggtcagaaacgagacccaaaagaatggattccccgtccacctgagaaatatgcattgagtggtcataggagtccagttactcgagtcattttccatcctgtgttcagtgttatggtctctgcttcagaggatgctacaattaaggtgtgggattatgagactggagattttgagcgaactctcaaggggcatacagactctgtacaggacatttcctttgaccacagtggcaagcttctggcttcctgttctgcagatatgacgattaaattatgggattttcagggttttgaatgcatcagaaccatgcacggccacgaccacaatgtctcttcagtagccatcatgcctaatggagatcatatagtgtctgcctcaagggataaaactataaaaatgtgggaagtgcaaactggctactgtgtgaagacattcacaggacacagagaatgggtacgtatggtgcggccaaatcaggacggcactctgatagccagctgttccaatgaccagactgtgcgtgtatgggttgtagcaacaaaggaatgcaaagctgagctccgagaacacgaacatgtggtagaatgcatttcctgggctccagaaagttcatattcttccatctctgaagcaacaggatctgagactaaaaaaagtggcaagcctggacccttcttgctatctggttccagagacaaaactattaagatgtgggacgtcagtactggcatgtgccttatgactctggtgggtcatgataattgggtacgtggagttctgttccattctggggggaagtttattttgagttgtgctgatgacaagaccctccgtgtatgggattacaagaacaagcgatgcatgaagaccctcaatgcgcatgaacactttgttacctccttggatttccataagacggcaccctatgtggttactggcagtgtagatcaaacagtaaaggtgtgggagtgccgttga

SEQ ID NO: 1947 - DNA, 861 bp, Rattus norvegicus
  Genbank Accession No. NM_031774
gaattcggcacgagcgcgctcgggtggggccgcctaggtgctgctgggctcggggatatttacagcggttctattcactgcagcgcgaacatggcggcccagaaggaccagcagaaggatgccgaagtggaagggctgagcgccacgaccctgctacccaagctgattccctctggcgcaggtcgagagtggctggagcggcgccgtgctaccatccggccctggggcaccttcgtggaccagcaacgtttctcgcgaccccgcaacgtaggcgagctttgccagcgcctggttcgcaacgtggagtattatcaaagcaactacgtgtttgtgtttctgggcctcatcctgtactgcgtggtgacatcccccatgctgctggtggctctggctgtcttctttggcgcctgttacattctctatctgcgcacgttgcagtctaagcttgtgctctttggccgtgaggtgagcccagcacatcagtacgccctggctggtggtgtctctttccctttcttctggctggccggtgctggctccgctgtcttctgggtcctgggagccaccctggtacttataggctctcacgctgccttccaccagatagagcctgcagatggtgaggaactgcagatggaacctgtgtaaagtgtcctccaggacctgccagcctctcctgccggcctctcctgcccgtggctgtcccctctctgtctgttcttgccctacctgacctagacactcagctcaactcagagcctaactctgagccttccaccctagacctcaaacccggggagaggcttttatcttcggaaataaaacagttacaattgaaaaaaaaaaaaaaaaaaactcgag

SEQ ID NO: 1948 - DNA, 1568 bp, Rattus norvegicus
  Genbank Accession No. NM_031776
aagagccagcagctccccgctctgcagccacagggaccgaccgctctgcgcccgcccggtgcaccctctttggtcagtgaacttgcgctgccccgctgctgccatgtgtgcggctcggaggcgcgagctggcgctcatcttccgagggactttcgtccactccacctggacctgccccatggaggtgcttcgcgatcaccttcttggcgtgagcgacagcggcaaaatagtgtttctagaagaatcatctcagcaagaaaagctggccaaagaatggtgcttcaaaccgtgtgagatcagagagctgagccaccatgagttcttcatgccaggccttgttgatacacacatccatgcccctcagtatgcctttgctggaagcaacgtcgacctgccacttttggattggctgaacaagtatacatttcctacagaaaaaaggttccagagcaccgatgtggctgaagaagtctacactagagtcgttaggagaacactaaagaacggcaccaccacggcatgctactttggaacaattcacactgactcatccctgatccttgcggaaattacagataaatttgggcagcgagcatttgtgggcaaagtatgcatggatttaaataacactgttccagaatacaaggagaccaccgaggagtcagtcaaggagacagagagatttgtgtcagaaatgcttcaaaagaattattcaagggtgaaacccatagtgaccccgcgattttctctttcttgcacggagactctgatgagtgaacttggcaacatcgccaagactcatgatctgtacatccagagccatataagtgaaaatcgtgaagaaattgaagctgtgaaaagcttataccctggctacaaaaactacacagatgtctatgataaaaacaatcttctgacaaacaaaacagtgatggctcatggctgctacctttctgaagaagagctgaacgtcttcagtgaacgaggagcatccattgcacattgtcccaactctaatctgtcgctgagcagtggcttactgaacgtgctcgatgtcctgaagcataaagtgaagatagggcttgggacagatgtggctggtggttactcctattccatgcttgacgccatccgaagagcagtgatggtttccaacgtcctcttaattaataaggtgaatgagaaaagcctcaccctcaaagaagtcttcagactagccactcttggaggaagccaagccctggggcttgatcgtgaaattggaaactttgaggtcggcaaggattttgatgccctcttgatcaaccccagagcatcggactctcccattgatctgttttgtggggatttcgttggtgatatttctgaggctgttatccagaagttcctctatctaggagatgaccgaaacattgaggaggtttatgtgggtggaaagcaggtcgttccattctccagctccgtgtaaggcccttggacatccatgacgctctcctgggaggacatgagtctgctatcttccttgtacccagggaccgatcagaaagtatattcaaaaaaaaaaaaaa

SEQ ID NO: 1949 - DNA, 2307 bp, Rattus norvegicus
  Genbank Accession No. NM_031789
gccgccgcctcacctctgctgccagtagcctcgccgtcggggagccctagcgcagcgtccgccctcagcatgatggacttggaattgccaccgccaggactacagtcccagcaggacatggatttgattgacatcctttggaggcaagacatagatcttggggtaagtcgagaagtgtttgactttagtcagcgacagaaggattatgagctggaaaaacagaaaaaactcgaaaaggagagacaagagcaactccagaaggaacaggagaaggcctttttcgctcagttacaactggatgaagagaccggagaattcctcccaattcagccagcccagcacatccagacagacaccagtggatctgtcagctactcccaggttgcccacattcccaaacaagatgccttgtactttgaagactgtatgcagcttttggcagagacattcccatttgtagatgaccatgagtcgcttgccctggatattcccagccacgttgagagctcagtcttcaccacccctgatcaggctcagtcactcgatagctctctggagacggccatgactgatttaagcagcatacagcaggacatggagcaagtttggcaggagctattttccattcccgagttacagtgtcttaatacggaaaacaagcagcaggctgagactaccactgtccccagcccagaggccacactgacagagatggacagcaattaccatttttactcatcgatcccctcactggaaaaagaagtggacagctgtagtccacatttccttcatggttttgaggattcttttagcagcatcctctccacggatgatgccagccagctgaactccttagactcaaatcccaccttgaacacagatttcggtgatgaattttactctgctttcctagcagagcccagtggcggtggcagcatgccttcctctgctgccattagtcagtcgctctctgaacttctgggcgggcccattgagggctgtgatctgtccctgtgtaaagctttcaaccagaagcacactgaaggcacggtggagttcaatgactctgactccggcatttcactgaacacaagtcccagccgagcatccccagagcactctgtggagtcttccatttacggagacccaccgcctgggttcagtgactcggaaatggaagagctagacagtgcccctggaagtgtcaaacagaatggacctaaagcacagccaacacattcttctggggatacagtacagcctctgtcgccagctcaagggcacagtgctgctgtgcacgaatcccagtgtgaaaatacaacaaaaaaagaagtacctgtgagtcctggtcatcaaaaagtcccattcacaaaagacaaacattcaagccgattagaggctcatctcacaagagatgagcttagggcaaaagctctccatattccattccctgttgaaaaaatcattaatctccctgttgatgacttcaatgaaatgatgtccaaggagcaattcaacgaagctcagcttgcattaattcgagatatacgcaggagagggaagaataaagttgccgctcagaactgtaggaaaaggaagctggaaaacattgtagagctggagcaagacttgggccacttaaaagacgagagagaaaaactactcagagaaaagggagaaaacgacagaaacctccatcttctgaaaagaaaactcagcactttgtatctggaagtcttcagcatgttacgtgatgaggatgggaaaccttactctcccagtgagtactctctgcagcagaccagagatggcaacgtgttccttgttcccaagagcaagaagccagatacaaagaaaaactaggttcgggaggatggagccttttctgagctagtgtttgttttgtacggctaaaacttcctactgtgatgtgaaatgcagaaacactttataagtaactatgcagaattatagccaaagctagtgtagaaataatatgaaactttacaaagcattaaagtctcaatgttgaatcagtttcattttaactctcaagttaatttcttgggcaccatttgggctagtttctgtgtaagtgtaaatactacagaacttatttatactgttctcatttgttacagtcatagacttatatgacatctggctaaaagcaaactattgaaaactaaccaaaccactatacttttttatatactgtatgaacaagaaatgacatttttatattaaattgtttagctctgataaaaattaaaaggagctagcactaataaaggaatatcatgactt

SEQ ID NO: 1950 - DNA, 416 bp, Rattus norvegicus
  Genbank Accession No. NM_031810
atctgtcagctcaactacctgggagtctcacgtcctctctgcactctggaccctgacttcaccgacatgaaaactcattactttctcctggtgatgttattttttctcttctcccagatggagctgggtgctggcattctcacaagtcttggacgcagaacagatcaataccgatgcctccaaaatggaggattctgtctccgctccagctgcccatctcataccaaactacaaggaacatgtaaaccagataagcccaactgttgcaggagttgacagtggtttgaagaatggacataaaggacagcaagggattgtaaaattagtgttttaataaatgaaatgtttttgaagtttatttacatcatctcaaaataaattttatgcctcagtttaaaaaaaaaaaaaaaaaaaaa

SEQ ID NO: 1951 - DNA, 3236 bp, Rattus norvegicus
  Genbank Accession No. NM_031814
gcccgcgccccccacgctggcccagagggctgcggccgcttcgccgctgaggatgtcccggaaggggccgcgagcggaggtgtgtgcggactgcagcgcccctgaccctggctgggcatctatcagcagaggtgtgctggtttgtgacgagtgctgcagtgtgcaccggagcctgggacgacacatctccattgtcaaacaccttcgccacagcgcctggcctcctacgctgctacagatggtgcacacgcttgccagcaacggggccaactctatctgggagcattccctgctggaccctgcacaagtgcaaagtggccggcgcaaagccaacccccaagacaaagtccaccccatcaagtcagagttcatcagggcaaagtaccagatgctggcgtttgtgcacaagcttccctgccgtgatgatgatggggtcaccgccaaagacctcagcaagcaactgcactcgagtgtgcgaacaggcaacctggagacctgtctgcgcctgctttccctgggtgcccaggccaacttcttccacccagaaaagggcactacacctctacacgtggctgccaaggcagggcagacactgcaggctgagctgctagtagtgtatggggctgacccaggctcccctgatgtcaatggccgcacacccattgactatgccaggcaggcggggcaccatgaactggcagaaaggctagttgagtgccagtatgagctcactgaccggttggccttctacctctgtggacggaagcctgatcacaagaatgggcattacatcataccacagatggctgacagatctcggcaaaagtgcatgtctcagagtttggatctgtctgaattggccaaagctgccaagaagaagctacaagcactcagcaaccggctctttgaggagctcgccatggatgtgtatgacgaagtggaccggagagaaaatgatgcagtgtggctagctacccagaatcatagcaccctggtgacagaacgcagtgctgtgcccttcctgccagtcaaccctgaatactcagccactcggaatcagggacgacagaaattggctcgttttaatgcccgagagtttgccaccttgatcatcgacatcctcagtgaggccaaacggaggcagcagggcaagagtctgagcagccccacagacaacctcgagctgtctgcacggaaccaaagtgacctggacgaccagcacgactacgatagtgtggcttctgacgaagacacagaccaggagcccttgcccagtgctggcgccacgcggaacaatcgtgccaggagcatggactcctcagatctgtcggatggggctgtgacgctgcaggagtacctggagctgaagaaggctctggctacctccgaggccaaagtgcagcagctcatgaaagtcaacagcagtctgagtgacgagcttcggaagctgcagagggagatccacaaactgcaggcagagaacctgcagctccggcagccaccaggaccagtgcctgtaccctcacttcccagtgaacgggcagaacacacactcatgggccctggtggaagtacccatcgcagggaccgccaggccttctctatgtatgagccaggctccgccctgaagccctttggaggtgcacctggggatgagctcgccacacggctccagcctttccacagcacagagctggaagatgatgccatctattcagtacatgtccctgctggcctttaccggatccggaagggggtgtctgcctcttctgtgaccttcactccctcctccccactgctgtcaagctcccaagaaggaagtcgccatgcgagcaagctttcacgccacggcagtggcgcagagagtgactatgagaacacacagagtggagagcctctgctgggacttgaagggaagcgattcctagagctgagcaaggaggatgagctgcacgctgagctggagagcttagatggagacccagaccccgggctccccagcacagaagatgtcatcctaaagacagagcaggtcaccaagaacattcaggagctattgcgggcagcccaggagttcaaacatgacagctttgtgccctgttcagaaaagatccatttggctgtgactgagatggcctctctcttcccaaagaggccagccctggagcctgtgcgcagttcactgcggctgctcaacgccagcgcctaccggctgcagagtgaatgccggaagacagtgcctccagaacctggcgcccctgtggacttccagctactgactcagcaggtgatccagtgcgcctatgacatcgccaaggctgccaagcagctggtcaccatcaccacccgagagaagaaacagtgaccactttccctgcccttacccacaccctgggacctcactggccatgggagctgggccactccagacactaacccacccccaacagagccactggcacaagtgcccttagtgccaccattctcctctggcatccaggtgccctggtgtccacacccccttaagccccaaggatgggaatgtgaggtgacaggaccatctgtcccccacattccacgcccctccctctgtacatagcatccctgccctgctgatacgcaggagcctcaaggagtccctcccagctcttcacctgccttccagggccccctcagcaaagggtgggacagggacactccaagtggggcagccccgcctactgcaccctatccccatgagccagttcagccctggggggtcgagcagaggcaccccctcctttgtgcattatctmtgggtgtytytgccccgtagccagcagcccccccgctgctctttcatgacaaatggcccctgccagagcacaggccccaacttgtgtgccagggtccccagcagcaaacactggaacgtctttctctcccctaccccttaattttaactttgtggtaactgagtgtccctgcgttcttacaactgagtgtgtgagcggcagtgccgtgccagagacctggtccacctggagctctgaggggcaggggaaccagagtagtgggaccagcattggaagtcagcttccctctacccaacctgggacggggactgtcagggtcaccagctgtggtccagttgctacccctacttgtatccctatcctataaacttaaaaggaaaaccacttccctccatctctccccatcccctgtgggaagtgtgctgaccaggcagaggacag

SEQ ID NO: 1952 - DNA, 1947 bp, Rattus norvegicus
  Genbank Accession No. NM_031816
gggctagaggcgcgggttgaaaagtctcgttccaagtttggagagagggagagagaggagagcgtctcagacctcgctacccgcaagcggggaggaggcagaagagaagatcgcggcgtctggggagcacccagacagccagaccgagctcaggctttccgagctaggagtgcgtgacgtgcctgggagaggcaggagcgcctgcgatcgggctgctcttgactagcgagagaagtccgaggcggcaaaggggggcgaacgacccgacgcaagatggcgagtaaagagatgtttgaagatactgtggaggagcgtgtcatcaacgaagaatataaaatctggaagaagaatacaccgtttctgtatgacctggttatgacccatgctcttcagtggcccagtcttaccgttcagtggcttcctgaagtgactaaaccagaaggaaaggattatgcccttcattggctagtgctgggtacccatacatctgatgagcagaatcatctggtggttgctcgagttcatattcccaatgatgatgcacagtttgatgcttcccattgtgacagtgacaagggagaatttggtggctttggttctgtaacaggaaaaattgaatgtgaaattaaaattaatcatgaaggagaagtaaatcgcgctcgttatatgccacagaacccacacatcattgccacaaaaacaccatcttctgatgttttggtttttgactatacaaaacaccctgcaaaaccagatccaagtggagagtgtaatcctgatcttagattaagaggtcaccaaaaggaaggctatggtctctcctggaattctaatttgagtggacatctcctgagtgcatctgatgaccatactgtctgcctctgggatataaatgcaggaccaaaggaaggcaaaattgtggatgctaaagcaatctttactggccactcagctgttgtagaggatgtggcctggcatctgctgcatgagtccttgtttggatctgttgctgatgatcagaaacttatgatatgggacaccagatccaatactacttctaagcccagccatttggtggatgcacacactgcggaggtcaactgcctctcattcaatccctacagcgagtttattctggcaactggctctgcagataagactgtagctttatgggacctgcgtaatctgaaactaaaactccacacctttgaatcccataaggatgaaatttttcaggtccactggtctccacataatgaaactattctggcttcaagtggtactgatcgccgcctgaatgtgtgggatttaagtaaaattggagaagaacaatcagcagaagatgcagaggatgggcctccagagctcctgtttattcatggaggacacactgccaagatttctgacttcagttggaaccccaatgaaccttgggtcatttgctctgtgtctgaagataacatcatgcagatatggcaaatggctgaaaatatttacaatgatgaagagtcagatgtcacgacatcggaactggaggggcaaggatcttaaacccaaagtatgagttgtttctattgaatgtattgctacacgaatgcttgatttgtcaagcgccaaaaaggcattgtatagtaggaaatgtaagtgggatggcttctggcattctttaccctctgattctagcactttcaagtgagctgttgcgtactgtatcatattgtagctattaggggaacaaaaaggaatgttgcttaagaatggacatcattgttttaaacacacattgctgggtattgcctttgattcaactgtcattttctcaaacttttaagtgcttgctcaagttcccaaatatgcgaggataacttttacactttttccttccaacacttcttgattggctttgcagaaataaagtttttaaaaaaaaaaaaaaaaaaaaaaaaa

SEQ ID NO: 1953 - DNA, 2781 bp, Rattus norvegicus
  Genbank Accession No. NM_031821
ccacgcgtccgggagccggacgtcggactagagagtagggagagcgattggggctcgagggacagggctagaccggacgcgtgtccgcgcctcggaggtggcagtaggtagtgtcgggtagcgaggcaacgatggagctcctgcggactatcacctaccagccggccgccggcaccaagatgtgcgagcaggcgctgggcaaagcttgcggcggggactcaaagaagaagcgaccgcagcagccttctgaagacgggcagtcccaagcccaggtgaccccggcggccccacaccaccatcatcaccattctcactccggacccgagatctcgcggattatagtcgaccccacgacggggaagcgctactgccggggcaaagtgctgggcaagggtggatttgcaaagtgttacgaaatgacagatctgacaaacaacaaagtctacgctgcaaaaattatccctcacagcagagtagctaaacctcatcaaagggaaaagatcgacaaagaaattgagcttcacagaatcctgcaccataagcatgtagtgcagttttaccactactttgaagacaaagaaaacatttacatcctcttggagtactgcagtagaaggtccatggctcatatcttgaaagcaagaaaggtgttgacagagccagaagtccgatactacctcaggcagattgtgtcgggactcaagtatcttcacgaacaagaaatcttgcatagggatctcaagctagggaacttttttattaatgaggccatggagctgaaggttggagacttcggcttggctgccagactggaacctttggaacacagaaggagaacaatatgtggaaccccaaattatctctcccctgaagtcctcaacaaacaaggacatggctgtgaatcagacatctgggccttaggctgtgtaatgtatacaatgctgctaggaagacctccattcgaaacaacaaatctgaaagaaacgtacaggtgcataagagaagcaagatatacaatgccgtcttcattactggcccccgccaagcacttgatagccagcatgctgtccaaaaacccagaggaccgccccagtttggatgacatcattcggcatgacttctttctgcagggcttcactccagacagactctcttctagctgttgccacacagttccagacttccacttgtcaagcccagctaagaatttctttaagaaagctgctgccgctctttttggtggcaaaaaggacaaagcaagatataatgacacacacaataaagtgtctaaggaagatgaagacatctacaagcttcggcatgatttgaagaaaacatcgataacccagcaacccagcaaacacagaacagatgaggagctccagcctcctccaactacctttgccaaatctgggacatccgcagtggaaaacaaacagcagattggagatgcaatccggatgatagttagagggacgctgggcagctgcagcagcagcagtgaatgccttgaggatagcaccatgggaagtgttgcagacacagtggcaagagtccttcgagggtgtctagaaaacatgcctgaagctgactgtattcccaaagagcagttgagcacgtcctttcagtgggtcaccaaatgggtcgactactccaacaaatacggctttggataccagctctcagaccacactgttggagtccttttcaacaacggcgctcacatgagcctccttccagacaaaaagacagttcactattatgcggaacttggccaatgctctgttttcccagcaacagatgcccccgaacaatttattagtcaagtgacggtgctgaaatacttttcccactacatggaggagaacctcatggatggtggcgatctccctagtgttactgacattcgaagacctcggctctacctccttcagtggttaaagtctgataaagccttaatgatgctcttcaatgacggcacatttcaggtgaatttctaccacgatcatacaaagataattatctgtaaccaaaatgaagaataccttctcacatacatcaacgaagacaggatatctacaactttcagactgacgaccctgttgatgtctggctgttcgctagaattgaaacatcgaatggaatacgccctgaacatgctcttgcagagatgtaactgaaaaacctcttttagagcggacctcgtgggggctcttttccactgtgagatcaacagggaagccagtggagggataacggagcatgttagagaaatcggacaggtgctggtacgaatacgagtcgtctgtggcctgctggactgctggaaccagaccagcctaaggtggacagttgactttgggcaatcttaagtgtggagccaagtacagttttccttgagatacctgtctttacaaagtttatcggacaattttgcagacagacgctttgactctgaagttctctctgtggagagtgttttcagttggaagacttggaactgtgaataaacttcctgaaggggagggagaagggaggaagctccctcgctgttgaaaggctacaatcagagcagcttttgtttggctgcttaactgtgaactatggccatacatatttttttttttggttatttttgaatacacttgtggctggaaaagtgcattccttgttaataaactttttatttattacagccccaagagcagtatttattatcaagatgtcttttttttttatgttgaccattttgaactcttggcaataaagagtatgaaatag

SEQ ID NO: 1954 - DNA, 2629 bp, Rattus norvegicus
  Genbank Accession No. NM_031830
tggggcgcggccggtgctgcggacccgccacagccctccaggtcgctgcggacccaaggcctgcttgcctgccagcggcaccatgggcaattgccacacggtgggccccaacgaggcactggtggtctcagggggctgttgtggttctgactacaagcagtatgtgtttggcggctgggcttgggcctggtggtgtatctcggacactcagagactgtctctggaggttatgaccatcctgtgtcgctgtgagaatattgagacgtcggagggggtcccgctattcgtaacaggggttgcacaggtgaagatcatgacggagaaggagctcctggctgtagcctgtgaacagttcctgggcaagaacgtgcaggacattaagaacgtcgtactgcagaccctggaggggcatctacgctccatccttgggactctgactgtggagcagatttatcaggaccgagaccagtttgccaagctggtgcgggaagtggcagcccctgatgttggccgtatgggcatcgagatcctcagcttcaccatcaaggatgtctatgacaaagtagactatctgagctccctgggcaagacacagactgccgtggtacagagagatgcagacatcggtgtggcagaggcagagcgggacgcaggcatccgggaagccgagtgcaagaaggaaatgctagatgtgaagttcatggcagacaccaagattgctgactccaagagagcctttgagctgcaaaagtcagccttcagtgaggaggtcaacatcaagacagctgaggcccagttggcctatgagctacaaggggccagagagcaacagaagatccggcaggaagagattgagattgaggtagtacagcgcaagaagcagatcgccgtggaggcgcaggagatcctgcgcacagacaaggagctcatcgccacagtgcgccgccctgcagaggcagaggcccaccgcatccagcagattgctgaaggcgaaaaggtgaaacaagtcctcttggcacaagcagaagctgagaagattcgcaaaatcggggaggcagaggcagcagtcattgaggccatgggcaaggccgaggccgagcggatgaagcttaaagctgaggcctaccagaagtacggggatgcggccaagatggccctggtgctggaggccctgccccagattgctgccaagatctccgcacccctgactaaagtcgatgagattgtggttctcagtggggacaacagcaaggtgacatcagaagtgaaccggctgctagcagaactgcctgcttctgttcatgccctcactggtgtggacctctcaaagataccactgatcaagaatgccactggtgcgcaggtgtgaggctcctggcactcggcctccagcagctgcctgcccttctagcgcctgttttcaagtcatggggacagcgagaacattactgactctggtgccttatttcgtagggaccagaagtgctgcgagttcaggccatctctggctatcttcccttctctcctgtctgccttctcttttttttccacaccttcacgttaactgccacatccatctagcctgtctcctcatctgccatatgtgcctcttcctctggctctgtttttctcccttctcccaacttcacacacatcatctactttaactgaagttgaacttgtttatgataatcactgtctgtctgtctgtctgtctgtctgtctgtctgtctgtctgtgaggagtggccccgctgcttctcaaaattctggtgccttcaagttctacatgtatctgtctgtcctcgctggccctggcagagcccagcatgggtacaagggttctgcgtaggacacccactctcctctctcctggtctgaatctccaagcgctaaatgctgttccaggaagcccacatctcacacagtcttgccctttgaggcctaagtggccatggcctattggccgtagcataatgcccttcccacaccgaggcccgggcctgctgtcatacctgcccctgtcccctgcaccatagaggcacagaagcacggcctcctgtctgtagcagcttcctcagtgtactactgccttaggaggccctgcttgtgctcagggacatcccttccgttggcttgtccttgattggtgggtgggtcttaatctgatcccactaagtctttctgggtcactatctagctctgttgggacaggtaaagtttataggccttcttcctgctagtgaatggggctctcccagggggcaaggctgtgccaaccgtaagagaatcaagtgctgaagactggccaaacttcactccctctatgccattttcttcttggtcagcataatgggtttctagccatgggaagcagctaagtgttctgtgtctttgcacctgcaccactggtggcagaagaacccagtgcccaggtgtcctagtaagggtgcaagggtgtctgtcccatgggcccagtccccagccctggcctgccccggcctgtgtagctgtgctgcatgtgaatgctgcatgtctggtctggggtttggatattgcactgccccactgcctgtcccccgctggtgacaataaagatctcttatagccacaaaaaaaaaaaaaaaaaa

SEQ ID NO: 1955 - DNA, 948 bp, Rattus norvegicus
  Genbank Accession No. NM_031832
aacagctagcggagcggcaggaggagcactaaccaggaaaatggcagacggcttctcacttaatgatgccttagctggctctggaaacccaaaccctcgaggatggcctggtgcatgggggaaccagcctggggcaggaggctacccaggggcctcctatcctggggcctacccaggacaggctcctccagggggttatcctggacaggctcctcctagtgcctatccgggcccaactggccctagtgcttatcctggcccaactgcccctggagcttatcctggcccaactgcccccggagccttcccagggcaacctgggggacctggagcctaccccagtgctcctggggcctaccccagtgctcctggggcctatcctgctactggcccctttggtgccccgactggaccactgacagtgccctacgatatgcccttgcctggaggagtcatgcctcgcatgctgatcacaatcataggcacagtgaagcccaacgcaaacagtatcactctgaatttcaagaaagggaacgacatcgccttccactttaacccccgcttcaatgagaacaacagaagagtcatcgtgtgcaacacgaagcaggacaataactggggaagggaagaaagacagtcagctttcccctttgagagcggcaaaccattcaaaatacaggtcctggttgaagccgaccacttcaaggttgcggtcaatgatgttcatctgttgcagtataaccatcggatgaagaacctcagggaaatcagccaactggggatcattggtgacataaccctcaccagcgcttcccacgccatgatctaagccagaaggggtgggccggcaccagaactgccctgtgtgttatgagcgggaaactttgcatttctctctccttatacttcttgtaagacatccatttaataaagtctcgtgctgagaga

SEQ ID NO: 1956 - DNA, 1227 bp, Rattus norvegicus
  Genbank Accession No. NM_031834
ggaattcgcaacgcctacacaaagatccctatcactgagcacccggaggcaaggctcagaaccccaggatcagcaacatggagttctcccgtccaccgctagtgcatgtgaagggtatcccactcatcaaatactttgcagagacaattgggccattgcagaacttcacagcctggcctgatgacttgctgatcagcacatacccaaagtctggtactacctggatgagtgagatcctggatatgatctatcagggtggcaagctagagaagtgtggccgcgcccccatctatgcccgggtacccttccttgagttcaaatgtccaggggttccctcaggtcttgaaactttggaagagacaccagccccacggctccttaagacacatctgcccctgtccttgctccctcagagtctgctggatcagaaggtcaaggtgatctacattgcccgaaatgcaaaggatgtggttgtctcctattataacttctacaacatggccaagctgcaccctgatccaggcacctgggacagcttcttggagaacttcatggatggggaagtgtcctatgggtcgtggtaccagcacgtgaaggagtggtgggagctgagacacactcaccctgttctctatctcttctatgaagacataaaggagaaccccaaaagggagatcaagaagattctagagtttttggggcgctctctacccgaggagactgtggattccattgttcaccacacatctttcaagaaaatgaaagagaactgcatgactaactacacaaccatccccactgagattatggaccacaatgtttctcccttcatgaggaaaggtactactggggactggaaaaataccttcactgtagcccagaatgagcgctttgatgcccactatgctaagacaatgacagattgtgacttcaagtttcgttgtgaactatgagtggattatggctatactgggaaccaaggcaaactgacacagcccatcatgatctcaagtaaaatgtgatgtgttcaatctacttgttgtatgcctagaggaaatctgagctaagagaataggattggggatgtggctgaggcagagggttttatcaacgcatgtcaggaaagcaatcagtcccaacacctaaaaagaacctaaagtacaaacatgcaaaaaatagtaagataaactatattttacctgaaagaataaatgccactgggaaatg

SEQ ID NO: 1957 - DNA, 2151 bp, Rattus norvegicus
  Genbank Accession No. NM_031835
ccgaaaagatgtctctagcctggagaacattgcagaaagctttctacctggagacctctctgagaatcctccagatgcgtccatccctgagctgtgcttctcggatatatgtacccaagctcactcttcatacaaagcacaacatgccaccatgtgacttctcacctgagaaataccagtctctggcctacaaccatgtcctggagattcataagcagcacctttctcctgtgaatacagcctatttccagaagcctttgctgctccaccagggacacatggaatggctctttgattcggaaggaaacagatacctggacttcttctctgggattgtaactgttggtgttggtcactgccacccgaaggtaactgccgtggcaaaaaagcagatggaccgcctgtggcatacaagttctgtcttcttccactctccgatgcatgaatatgcagagaggctgtcagcactccttcctgagcctcttaaggtcattttcttggtaaacagtggatcagaagccaatgacctggccatggtgatggccagggcatactcgaaccacacagacatcatttctttcagaggagcctatcatggatgtagtccctacacacttggtctgacgaatgtaggaatttacaagatgaaagtccccagtacgatagcctgccaatcgacaatgtgcccagatgttttccgtgggccttggggaggaagccactgtcgggattctccggtgcaaacagtcaggaaatgcagctgtgctccagatggctgccaagctaaagaacggtacattgaacagttcaaagacacactgaacacttctgtggccacgtcaattgctggattttttgcagagccaattcaaggtgtgaatggtgttgtccagtacccaaaggagtttctgaaggaagcctttgcactggttcgagagaggggaggtgtatgcattgcagatgaagtgcagacaggctttggaaggctgggctctcacttctggggtttccaaacacatgatacaatgcctgacattgtcaccatggctaaagggattggaaatggcttccccatggcagcagttgtgaccactccagaaattgcgagctctttggctaaacacttacatcacttcagcacatttggaggaagtcccctggcctgcgccattggatctgctgtgcttgaggtgattgaagaagaaaatctccagagaaacagtcaagaagttggcacctacatgctgctaaagtttgctaagcttcgggatgaatttgacatcgttggggatgtgcgaggcaaaggccttatggtggggatagagatggttcaagacaagataagccgccagcctcttcctaaaacagaagtcaatcaaatccatgaggactgcaaagacatggggctcctagtgggtagaggtggtaatttttctcagactttccgcattgcgcccccgatgcgtgtcacaaagctggaagtggattttgcatttgaagtatttcgttctgccttaactcaacacatggagagaagagctaagtaagaagagccccaagcctcaagaacttctcaactatgctcagagttggattggagagatgctgaaaccacaagtattagatagaaaaaaaccctgcagccctctgaagtaattgtaaaagactcgatggactatctactggctacatttgtcaactgagtccccattctcctgataattccatccttcaggagaagtatctgtcactggctcacagaataagtcttagtttgtgtagattagtctgggctaatgttatttcccgttgcattaactggtttgtaaatgaatacacagtatatgtgtcgccgatgagtcctgaagtaaatcctttccgtgacactacctctgggcaaacattttttcatgcttcagctcagatgcctctcgtcacactggaaacttcggcctctcatgatgcggtttctcaattcacaccaggcacctggaagccctgtagggataaagcctggtcactgtactacgctgggaatgtggttggaagctaagaggttggtaatgtcaatgaatcactgaccatgaatcctggaaccaccctatctcagggtttcttgatttatgaaacaataaattcgtggtgctgctt

SEQ ID NO: 1958 - DNA, 645 bp, Rattus norvegicus
  Genbank Accession No. NM_031836
atgaactttctgctctcttgggtgcactggaccctggctttactgctgtacctccaccatgccaagtggtcccaggctgcacccacgacagaaggggagcagaaagcccatgaagtggtgaagttcatggacgtctaccagcgcagctattgccgtccaattgagaccctggtggacatcttccaggagtaccccgatgagatagagtatatcttcaagccgtcctgtgtgcccctaatgcggtgtgcgggctgctgcaatgatgaagccctggagtgcgtgcccacgtcggagagcaacgtcactatgcagatcatgcggatcaaacctcaccaaagccagcacataggagagatgagcttcctgcagcatagcagatgtgaatgcagaccaaagaaagatagaacaaagccagaaaaaaaatcagttcgaggaaagggaaagggtcaaaaacgaaagcgcaagaaatcccggtttaaatcctggagcgttcactgtgagccttgttcagagcggagaaagcatttgtttgtccaagatccgcagacgtgtaaatgttcctgcaaaaacacagactcgcgttgcaaggcgaggcagcttgagttaaacgaacgtacttgcagatgtgacaagccaaggcggtga

SEQ ID NO: 1959 - DNA, 819 bp, Rattus norvegicus
  Genbank Accession No. NM_031838
aacaccaaatggcggatgacgccggtgcagcgggagggcccggaggacccgggggcccaggattaggaggccgcggcggcttccgcggaggtaaagctgaagacaaggagtggatccccgtcaccaagctgggccgcctggttaaggacatgaagatcaagtccttggaggagatctacctgttctccctgcccattaaggagtctgagattattgactttttcctgggtgcatctctaaaggatgaagttctgaaaatcatgccagtgcagaagcagactcgggctggccagcggaccaggttcaaggcctttgtcgctattggggactacaatggccacgttggtcttgtgttaagtgctccaaggaggtagccactgccatccgaggggccatcatcctggccaagctttcgatcgtcccagtgcggagaggctactgggggaacaagattggcaagccccacactgtgccatgcaaggtgacaggccgctgtggctctgtgctggttcgtctcatccctgcccccagaggcactggcattgtctctgctcctgtgcccaagaagctactgatgatggctggtatagatgactgctacacttcagccaggggctgcactgctaccctgggcaactttgccaaggccacctttgatgccatctccaagacctacagctacctgacccctggcctctggaaagagactgtgttcaccaagtctccttatcaggaattcactgaccatcttgtgaaaacccacaccagagtctctgttcagaggacccaggctccagctgtggctaccacataagggtt

SEQ ID NO: 1960 - DNA, 5055 bp, Rattus norvegicus
  Genbank Accession No. NM_031841
ctgggctagggatgggcacaatgcggtgttggtgtctgcagtattctactcctggacaccggtggcctgcaagtgcgcttttggcgtcctctcatttttctatccttatctccgtccgcggctgccttggccagccagtttttgattttttatctgttccttgatcgatacaaagaacctaaggacatacaggacattaatacccaactgccagctctggcccagggcttgtactgtgcagcgggctggctgcagaaacttaagtcataacactctttgtcgctgaggtctgaagctctctgcacgttctcatccctgggaacgtgaccccagcatccgacgccaagatgccggctcacatactgcaagagatctctggctcttactcggccaccaccacaatcacagcgccaccttctgggggacagcagaatggaggagagaagtttgaaaagaatcctcaccactggggagcagatgttcgccctgaaattaaagatgacctatacgaccccagctaccaggatgaggaggggcccccgcccaagctggagtacgtctggaggaacatcatcctcatggccctgctgcacattggagccctgtacgggatcacactggtcccctcctgcaaggtctacacctgcctctttgcatatttgtactacgtaatcagcgccctgggcatcacagccggggctcatcgcctgtggagccacaggacttacaaggctcggctgcccctgaggctctttctcatcatcgccaacaccatggcattccagaacgatgtgtacgaatgggcccgggatcaccgcgcccaccacaagttctcagagacacacgccgaccctcacaactcccgccgtggctttttcttctctcacgtgggttggctgcttgtgcgcaaacacccggctgtcaaagagaagggcggaaagctggacatgtctgacctgaaagctgagaagctggtgatgttccagaggaggtattacaagcccggcctcctgctcatgtgcttcatcctgcccacgctggtgccctggtactgctggggtgagacgtttgtaaacagcctgtgcgtcagcactttcttacggtacgctgtggtgctcaacgccacctggctggtgaacagcgccgcccacctctatggatatcgcccctacgacaagaacatcagctctcgggagaacatcctggtgtcgatgggagctgtgggcgagggcttccacaactaccatcacgccttcccctatgactactctgccagtgagtaccgctggcacatcaacttcaccacgttcttcatcgactgcatggccctcctgggcctggcttatgaccggaagagggtgtccaaggccgctgtcttagccaggattaagagaactggggaggagagctgcaagagtggctgagttcggggtcttccagttcctgttccaagagccggcttggcagaggcttactgttctgttaattaactactgagtattgctacccagatgctaaaatgatgaagttaacccattctggtacagtattgtaaaacggacaaatatcggaagtcaacagctctaccttttgatgctaagctgttctccccttctatcttcttttcccgttgtctttttcttcgctttgtccccaatgacctcacccctcatcgcctcccctaagccagcagccactccgctgtagttcagagttcaccttccagagcgtaccagcttttcaagggtctacagtaaaggttcacgccccagccccaacttaacgttgctccaagttacagatagaagaaaaatcttgagaaatttctcctgttattttagtccagactttgccagatggaatgggagaaaaaatagttttatttggcagagagcttgcgaagtgggtaaatcttaaggggccaaattcaacactcgggctgtgattcatcaaaattgtgggagagggggatctcctgtgatcaggctccgctccgtctggccgaggtgctggcgtctcttgacacagcgtgcctcctctcctaattctgattgggtgacagccgtggaactttgtgacactaaaatatggcaacacatcggtatctcagtgtactttaggctaaagatttaaaaaaatagagaagtgaaaaacaatttgtaggaaaagtggtctttcctaaaataagattttcttttcctttcataacaaggacctggggccaggcgtcgtggcacccgcctcaaaacagttgagaggagaggggcaggtgggtctctgagtttgaagccagccagggctagatagtgaggccttgtctcaaatagaaaagccaacaattagcaggacacacggagccgggggtcctcttgcgaggcgtgtctggaatccatgagggcggtcgctcgtggtttttgagcttcctgtgagctgcacccccagacacttgtaattcctgttcttccgtctttcggatgcaggttgctcccacaaattcaggatagctatggcgtttccatgcatcccacaatggaaggagtgtaagacttgagcttgagtcacagctaaaacccagaagacacaaagtcagtctgtcctggatcctacaaacactcaacgagtgcctccctctggaaaagatggtgaacaccttccttccactgttgggcagtggacagggaagttggaggtcgctgtaggcagctccaaggtttctaggggcaccttgccaggggacctcacaactttggcggtctctagtggagcaggttaggttttagctccctttggttcccgctgtgctttgtggtaaggcttttccctgggctgttgcctcattcctcactagctctgtgaccaggtaggactctgggatacatggctgaaagctcttttgctctaccacatctgcctctctttccctacccatttttttgtgtttcggggtggtatttttgtggtggttgttttgttttatttcttctttcctctttgacgtttagtcttgctctaggcagaaacgtcctggatatttacggtcagtaaagatgtccggtcccagcagagatacaacctctatctgcagtaggtagagaaggctgtccctttccggtggctttcagattctccacctctatccctcccaggcctctgatattctttaaactttaaaggaaaagtttggccgactttctagaaacatccctggctcagagaggctctctgtctcctcggttgttctaaaacaaatggtccgggtggtgtgggtgctggcccaagactcgattcctctgagttagggcagagcatgctccctgcactcagcaaagcctctcgggctgatcagtgctcctgggtgatgctgtggtgcttttaggaggaagacagtgttggctggctggaaagcatgacagttaaggttgtgttcttaagtgcctcagtttgaaagctttggctagggtaggagatctgagatgccgtggactttgcagaagagattttgtgcagcaacgcagaagcctggctgtgttaagattggctgtacaggatagcgaatgctgtggttggagggcacagtcttcccgtgttagttaaatagagaggctttaggacgtctctgcgcccacttgaaggtagccttatcctttagctgttcgctaaaatagaatccttgagagattgacaatatatttgctggcctgtcgccctattccttggagaggccttttgaatggttttaattccactggttatccggtgcccacttaatcaaatgtgaaaaataaaaagcagctctcttcttagcctgcccccgtggatctgaggaccctgttagatacagctgtcggtaagggtgtaccagctcactaagaaacactactgtcaagattttaaagctcagaccaagtgacacgttaataagaaactaagatctgattgaattttctaacagtccttgcctcgtggacacgctaaaattcgacttgggtgccttacctcttttctaactagtgttactcatgggcctgcgctcccttcctctgcggattccttagaaccggagagcctgtaagtgtgacaggctcaaaactggcctggctggagggttaggtggactttgatctgcagtgttccctctggggtcttcgtttggggaatatttcttggggctgttttgctgaagtgcccgtagctgatggatggtggaagtaatttgaacgtacgcgatttgtaggttttgttatttgttttaagatttaaaggctggttgtagcatttaaaagtgaaagctttttcttcctggtttgctagtgttctgcgtgtcttctttagttgaaataggttagtggagaagttaagaaagcggtggccgtgttacgctggtggtgaaggccagggccgcctacaaactctcagttttgttttgttttgtttttttataacagtcccactctgacaataatgagttcactccttggataaggttgttaatgagggaagagcccttcagacctaatcagctcttactggacccagctgtcaacactgttgcattggggattaagtttccaaccccgtgaatcatgggacagactcaaaccgtagcactgggcatgtcgcctaacaatataatgtgactcagtattctgtgagacatgggataatattcctgacctacctccacgggtaggtgcgagcatgagcaaatgctctttataaaacatttggggatcctcagcagaggagtatttaagtcctgcacatttttatagtaaccgtccaccatggacttgacacgtgcctatgtcccagacgacattgttaatctacatcattcttctcagaggttgaatggatgcattagataatgtatactcattgctatggaaacctgcaggactccttttccttccttgggtgggatttttttttcctttattatgtgcaacagtagctatttgtaatctaataattttcattaataccaactctgaaagtatttctactcatctgaggttgtgtttgttcataataaaatgaaatggatctgactgc

SEQ ID NO: 1961 - DNA, 1342 bp, Rattus norvegicus
  Genbank Accession No. NM_031855
gcagccagacgccaggctggatgaaatgaagaaggcaatggcaggcagtggtgccagcctctgaggtgtcgagctgctacctcccaccgctcatctctcacacaatgccatcaaacccctgcaagccacacttcttgccagccacctggcacccgaatctcagggcctcctgcatgctgtttcccttggagaggctgaagagacagagtctagcaggaatcccctccgcttgcgggtaggaagcttggggagcagcctcatggaagagaagcagatcctgtgcgtggggctggtggtgctggacatcatcaatgtggtggacaaatacccagaggaagacacggatcgcaggtgcctatcccagagatggcagcgtggaggcaacgcgtccaactcctgcactgtgctttccttgctcggagcccgctgtgccttcatgggctcgctggcccatggccatgttgccgacttcctggtggccgacttcaggcggaggggtgtggatgtgtctcaagtggcctggcagagccagggagataccccttgctcctgctgcatcgtcaacaactccaatggctcccgtaccattattctctacgacacgaacctgccagatgtgtctgctaaggactttgagaaggtcgatctgacccggttcaagtggatccacattgagggccggaatgcatcggaacaggtaaagatgctacagcggatagaacagtacaatgccacgcagcctctgcagcagaaggtccgggtgtccgtggagatagagaagccccgagaggaactcttccagctgttcggctatggagaggtggtgtttgtcagcaaagatgtggccaagcacctggggttccggtcagcaggggaggccctgaagggcttgtacagtcgtgtgaagaaaggggctacgctcatctgtgcctgggctgaggagggagccgatgccctgggccccgacggccagctgctccactcagatgccttcccaccaccccgagtagtagacactctcggggctggagacaccttcaatgcctctgtcatcttcagcctctccaagggaaacagcatgcaggaggccctgagattcgggtgccaggtggctggcaagaagtgtggcttgcaggggtttgatggcattgtgtgagagatgagcggtgggaggtagcagctcgacacctcagaggctggcaccactgcctgccattgccttcttcatttcatccagcctggcgtctggctgcccagttccctgggccagtgtaggctgtggaacgggtctttctgtctcttctctgcagacacctggagcaaataaatcttcccctgagcc

SEQ ID NO: 1962 - DNA, 3513 bp, Rattus norvegicus
  Genbank Accession No. NM_031969
gtgcagccaccctcgcctgcctcgctcttccttccttcgctcgcaccatggctgatcagctgactgaagaacagattgctgaattcaaggaagctttctccctatttgataaagatggggacggcaccatcacaacaaaggagctggggactgtcatgcggtcactgggtcagaacccaacagaggctgaactgcaggatatgatcaacgaggtggatgccgacgggaatggcaccattgacttcccagagttcttgactatgatggctagaaaaatgaaagacacagatagcgaagaagaaatccgtgaggcattccgagtctttgacaaggatggcaatggctacatcagtgcggcagaactgcgccacgtcatgacaaacctcggggaaaagctaacagatgaagaagtagacgaaatgatcagagaagcagatattgatggagacggacaggtcaactatgaagaattcgtacagatgatgactgcaaaatgaagacctactttcaactactttccccctctagaagaatcaaattgaaatcttttacttacctcttacaaaaaaaaaaaagaaaaaagaaaaaagttcatttcttcattctgtttgtatctagcaaaactgaatgtcaaaagtaccttctgtccacacacaaaatctgcatgtattggttggtggtcctgccccctaaagatcaagccccctacatgagttttacagtataaatactcgtactaccttataaggaagcacttagtggactccttcaagttccatttgctaatgattaacacactgtctgggctggccagtttctcatgcatgcagcttggtgattgagcacagtcaggcctttgtattaaaactgaaaaatggaaaaaacaaattcaaactctcagatggcttctagttcaatctgttcagataaatgtcagcagccagtttaccgcaaacaaacatttaaaattggtttacctcaggatgatgtgcaggaaacgggtgaaggctaaactttgagacacagccctagatgtaggacagtcctcttcaagtgccccaatcccatggtgacagtgacaccctggtggcgagcccgagtgtgatggttcaccgctgtgcacattgcattggagtgaagtgaacaaggctgtcaccaaatcacacacgttttaataagaaatgtttactaagggagcatctttggactctctgttttaaaaccttgtgaaccatgactcggagccagcagagtaggctgtgtctgtggacttgagcacaccatcaacattgctgttcaggaaattataatttacgtccattccaagttgtaaatgctagtcttttattttttttttccaataaaaagaccattaacttaaaagtggtgttaaatggtttgtaaagctgagcttggaagggggacaaggccgttggaggggaggtcagcggacatagaaacacccaacgtccagtacaagctggatttcccgcccaggttctctagcatcaacccctgaaaccagacagattctttgtcatctacgaccatgtaagtctagttattcaaatctgcgcgcatgcgcaaatcatggtgaattgatacttggagtagagccctagtgaaggaaggcctcaagcattcagtaaggatgtcttggctgtgctgctgctgacctgttgaagtacatgaggccatctgtgcaggagacatgatttagtgtgtgtgtaatcctatactcactgtgtatggtgaagcaggccagtcaaagacactacctttgattcagtttaatttatggttatacttaactttagccttttttattatttaagttcactgctttttctccccctaagtagagttaatgcttaacactgtcttgaaagcaaaacaatatcccagaatgaattttgtgtcttaattacgaacctgtaaccaaaacgtacatgtgctggtactggtcccttagcccaaggcactgggctatttaaaaagtcccccttaagaagtgtgttgcatttaaaacaagggccttgtacatttttcagggtgttaactggctgtatctgattaataaggagtgttggcttccaaattcgggggtggcagggagctggcaggcttgtagcaaggcaatgagaagcccttggcaaccacacgggtgcactcggggtaacctacagacccctggttgctccttctcctgctccctgtctttctggcgttttgtagctccttagaattttttttctttctgccaggaggataggtcagagcagtagagaggaagacattgcctgagcgcttctgctcatctttggactgggtggttggcagacaggtcgatgggtggtaaattgacttcagtatcggactcagtaggtattcccttttggtagagaggactgagggctccaggtgtgaagtgaatggccgtggatatgttgtgtaagaggattaagtcgcccagtcgatgacccagtctcaggcttgtggtctgttacctcttggtagtttcaaagggggtcggaggtggctttttaaaaacaatttaccccctatctttaaccatttaccaagtctgtagaagctgggtagacaatattttagcagctccgtagcctgtcctaaaaggttaccttctaaacaggattcttgtgtggccagggatcctgcatgggaactggaaacccctaacccccggggggtgggaagcaggagtttggaactgtaggaggcagagtccccccacctcctcagccttctggcatccaggggcacaagcagcccagggcttggtgttggcagtctgagttcgtgaggtagaaagagtggggtgtcaaggcagtacccctgaagttggatagtactttcctgtaaactgtccctcacttataactactctataaatatatgcatatatttatataaatatatatatataagtgactggttagctggcatcctgctttagcctgagacttgccctaagaaactgctgagcccttggtaaacgtctacacagtaagtttttctgtctgttggggggagctgttgaacaaggcagacatcttgatagttcagatgggctttaatgtactgttgccagggaaggctttttctggttttttgacaaatttttagcacacttcaattggtgtctcgagcaactttaacacattgaagatgaggtattgtacatatttttatattctctttataagtgcatgtctccaacttgtaaccaatattgtacggaatggctgtccagtaggcctagtgtttctgtcacacgagagggatagcatgtaccattcacccctcagcatcctgggagcttcttcttgaatgaagactgtaaatttggtcaagtcaactcttagttcggtttccttaccatttgaatgattgactgtgtgtcctgcgtgtatttctcttttggcagcgaccagagttacactgatgtgtctcaaccgacccactcggctggcaaccacctatttattttct

SEQ ID NO: 1963 - DNA, 787 bp, Rattus norvegicus
  Genbank Accession No. NM_031970
gcacttctcggatcctcagcccagtgcttctagatcctcagccctgaccagctcagccaagaccatgaccgagcgccgcgtgcccttctcgctactgcggagccccagctgggagccgttccgggactggtaccctgcccacagccgcctcttcgatcaagctttcggggtgcctcggtttcccgatgagtggtctcagtggttcagctccgctggttggcccggctatgtgcgccctctgcccgccgcgaccgccgagggccccgcagcagtgaccctggcccggccgttcagccgggcgctcaaccggcaactcagcagcggtgtgtcagagatccgacagacggccgatcgctggcgcgtgtccctggacgtcaaccacttcgctcctgaggagctcacagtgaagaccaaggaaggcgtggtggagatcactggcaagcacgaagaaaggcaggatgaacatggctacatctctcggtgcttcacccggaaatacacgctccctccaggtgtggaccccaccttggtgtcctcttccctgtcccctgagggcacactcacggtggaggctccgctgcccaaagcagtcacacaatcagcggagatcaccattccggtcactttcgaggcccgtgcccaaattggaggcccagagtcggaacagtctggagccaagtagaagccttcagcttgctacccatccccagtagccgtcaccagccctccctctctgtcaatctgaatgctcttttgatacatgtactttctgttttactcaaataaa

SEQ ID NO: 1964 - DNA, 2455 bp, Rattus norvegicus
  Genbank Accession No. NM_031971
agagaagcagagaagcagagcaagcggcgcgttcccgaacctcgggcaagaccagcctctcccagagcatccccaccgcgaacgcacccttctccagagcataccccagcggaggccacccttccccagagcatccccgccgccaagcgcaaccttccagaagcagaccgcagcgacatggccaagaaaacagcgatcggcatcgacctgggcaccacctactcgtgcgtgggcgtgttccagcacggcaaggtggagatcatcgccaacgaccagggcaaccgcacgacccccagctacgtggccttcaccgacaccgagcggctcatcggggacgccgccaagaaccaggtggcgctgaacccgcagaacaccgtgttcgacgcgaagcggctgatcggccgcaagttcggcgacccggtggtgcagtcggacatgaagcactggcccttccaggtggtgaacgacggcgacaagcccaaggtgcaggtgaactacaagggcgagaaccggtcgttctacccggaggagatctcgtccatggtgctgaccaagatgaaggagatcgccgaggcgtacctgggccacccggtgaccaacgcggtgatcaccgtgcccgcctacttcaacgactcgcagcggcaggccaccaaggacgcgggcgtgatcgcgggtctgaacgtgctgcggatcatcaacgagcccacggcggccgccatcgcctatgggctggaccggaccggcaagggcgagcgcaacgtgctcatcttcgacctggggggcggcacgttcgacgtgtccatcctgacgatcgacgacggcatcttcgaggtgaaggccacggcgggcgacaccgacctgggcggggaggacttcgacaaccggctggtgagccacttcgtggaggagttcaagaggaagcacaagaaggacatcagccagaacaagcgcgcggtgcggcgcctgcgcacggcgtgcgagagggccaagaggacgctgtcgtccagcacccaggccagcctggagatcgactctctgttcgagggcatcgacttctacacgtccatcacgcgggcgcggttcgaggagctgtgctcggacctgttccgcggcacgctggagcccgtggagaaggccctgcgcgacgccaagctggacaaggcgcagatccacgacctggtgctggtgggcggctcgacgcgcatccccaaggtgcagaagctgctgcaggacttcttcaacgggcgcgacctgaacaagagcatcaatccggacgaggcggtggcctacggggcggcggtgcaggcggccatcctgatgggggacaagtcggagaacgtgcaggacctgctgctgctggacgtggcgccgctgtcgctgggtctggagaccgcgggcggcgtgatgacggcgctcatcaagcgcaactccaccatccccaccaagcagacgcagaccttcaccacctactcggacaaccagcccggggtgctgatccaggtgtacgagggcgagagggccatgacgcgcgacaacaacctgctggggcgcttcgagttgagcggcatcccgccggctcccaggggcgtgccccagatcgaggtgaccttcgacatcgacgccaacggcatcctgaacgtcacggccacggacaagagcaccggcaaggccaacaagatcaccatcaccaacgacaagggccgcctgagcaaggaggagatcgagcgcatggtgcaggaggccgagcgctacaaggcggaggacgaggtgcagcgcgagagggtggctgccaagaatgcgctcgagtcctacgccttcaatatgaagagcgccgtggaggacgagggtctcaagggcaagatcagcgaggctgacaagaagaaggtgctggacaagtgccaggaggtcatctcctggctggactctaacacgctggctgagaaagaggagttcgtgcacaagcgggaggagctggagcgggtgtgcaacccgatcatcagcgggctgtatcagggtgcgggtgctcccggggctgggggcttcggggcccaggcgcccaagggaggctctgggtcggggcccaccatcgaggaggtggattagaggcttttctggctctcagggtgttggctagagacagactcttgatggctgctggtgcacgattcttatcaagttactccttctctccggagttcagtttaaagttacagccttttatacggtaattgatttgagtttgttacattttgtatgctcgtgggttttttatatattcaaattaaggttgcatgttctttgcgtttaatctaagtagctgtgtaaaaatggtgtttccttcctgcgaacacctcagcactgccaccctgtgtacagttttttccttgcatccctacaaactgagaaaaaaagttatcttttgtaacttaaacattcaaaataaaatgttacaagt

SEQ ID NO: 1965 - DNA, 3089 bp, Rattus norvegicus
  Genbank Accession No. NM_031978
gatacactgcgcagtggaacggcgagtgcagggcgcagccatgatcacttcagccgctggaattatttctcttctggatgaagaagagccacagctcaaggaatttgcactacacaaattgaatgcagttgtgaatgacttctgggcagaaatttctgagtctgtagacaaaatagaagttttatatgaagatgaaggtttccgcagtcggcagtttgcagccttggtggcatcgaaagtattttatcacctgggggctttcgaggagtctctgaattatgctcttggagcaggtgacctcttcaatgtcaatgataactctgaatatgtggagactattatagcaaaatgcattgatcattataccaaacagtgtgtggaaaatgcagatttgcctgaaggagaaaagaagccaattgaccagagattggaaggcatcgtgaataagatgttccagcgatgtctcgatgatcacaagtataagcaagcgattggcattgctctggagaccaggagactagatgtgtttgagaagactatactggaatctaatgatgtcccaggaatgctagcttacagcctcaagctctgcatgtctttaatgcagaataagcagtttcggaataaagtattgcgagtcctggttaaaatctacatgaacttggaaaaacctgatttcatcaatgtttgtcagtgcttaatcttcttagatgacacccaggccgtgagtgatatcttagaaaagctggtaaaggaagacaacctgctgatggcctatcagatttgctttgatttgtacgaaagtgccagccagcagtttttgtcatctgtgatccagaatcttcgaactgttgggacccctattgcttctgtgcctggatctaccaatacgggtactgtgccaggaccagagaaagacagtgactctatggagaccgaggagaagacagccggtgcagtggcagggaaaacaccagacgctagtccagagcccaaggaccagacattgaaaatgattaaaattttaagtggtgaaatggctatcgagttacacctgcagttcctaatacgcaataataacacagacctcatgattctgaaaaacacaaaggatgcagtacgaaattctgtatgtcatacagcaactgtaatagcaaactcattcatgcactgtgggactaccagtgaccagttccttagagataacttggaatggctggccagagccactaactgggccaaatttactgcaactgccagcttgggtgtaatccataagggccatgagaaggaagcactacagttaatggcaacatacctccctaaggacacttctccaggatcagcctatcaggaaggtggaggtctctatgcattgggtctcattcatgccaatcatggtggtgacataattgactatctccttaatcagctcaagaatgccagcaatgatatcgttagacatggaggcagcttgggccttggtttggctgcaatgggaactgcacgtcaggatgtatatgatttgctgaaaacaaacctgtatcaggatgatgctgtgacaggggaggcagctggcctggccttaggtttggttatgttaggctctaaaaacacccaggcgattgaggatatggttggctatgcacaagaaactcaacacgagaagattctgcgtggtctagcagttggcattgcgttagtgatgtatgggaggatggaggaggccgatgctctcattgaatctctctgtcgtgataaggacccaattcttagaagatctggaatgtatactgtagccatggcttattgtggctctggtaacaataaagctattcgacgcctgctgcatgttgctgtaagtgatgtcaacgatgatgtcagaagagcagcagtagagtctcttggcttcattttgttcaggacgcctgaacagtgtccaagtgtggtctctttgttgtccgagagttataaccctcatgtgcgctacggcgctgcaatggccctgggagtctgctgtgctggtacaggaaacaaggaagcaattaatttactggagccaatgaccaatgaccctgtgaactacgtgcggcaaggggctctgatagcctcagctctcatcatgatccaacagaccgaaatcacgtgtccaaaggtaaaccagttccggcagctgtattccaaagtcatcaatgacaagcatgatgatgtcatggccaaatttggcgctattctggcccaaggcatactggatgcaggtggtcataatgtcacaatctccttacagtccaggactgggcacactcatatgccttctgtggttggcgtccttgtctttacccagttctggttctggtttcccctttcacacttcctatcattggcttatactcctacctgtatcatcggccttaacaaggatttaaagatgccgaaagttcaatataaatcaaattgtaaaccatccacattcgcataccctgcccctctggaagttccaaaagaaaaagaaaaggaaaaggtttccaccgctgtgttgtctattactgccaaagctaaaaaaaaagaaaaagaaaaagaaaaaaaggaggaggagaagatggaagtggacgaagcagaaaagaaggaagagaaagagaagaaaaaagaaccggaaccaaacttccagctgttggataatccagcacgggtcatgcctgcccagctgaaggtcttaagtatgacagagacctgcagataccaacccttcaagccactctccatcgggggcatcataattctgaaagacaccagcgaagacattgaggaacttgtggaacccgtggcagcacatggcccaaagattgaagaggaggagcaggagccagagcccccagagccatttgagtacatcgatgactagggccagggatcccacctgctcagctgtagatgactatcctggcacacactgaaatgtcgtgagggaacccacgctgagacccgctcgatccacacatcattgcctacgctgacataaggaacccgtgtcctgagtctttgattgagaagattctgactgttcagtgttctctttcacaaaaaaaaaa

SEQ ID NO: 1966 - DNA, 2280 bp, Rattus norvegicus
  Genbank Accession No. NM_031984
tgtaaatacagggctgaaagtgggagtggcgctccctcttcctgttatccccttggctcagcctcactgcctgatagaaatgtttctaatatggcacctggtcacagtccattgtagctgaactcccaggtcctgcactgtacaaccctcaccttcccagttcccttaccacctaataaagggcctgcctccggacagcgcccggcccgccgcgcccagctcagcctgctcagccctctggtcccgaggttccgctcagcgctctctcaaactagccgctgcaccatggcagaatcccacctgcagtcatctctgatcacagcctcacagttttttgagatctggcttcatttcgacgctgatggaagtggttacctggaaggaaaggagctgcagaacttgatccaggagcttctgcaggcacgaaagaaggctggattggagctatcacctgagatgaaaacctttgtggatcaatatgggcagagagatgatgggaaaataggaattgtagagttggcccatgtcttacccaccgaagagaatttcctgctgctctttcgatgccagcaactgaagtcctgcgaggaattcatgaagacttggagaaagtatgacactgaccacagtggcttcatagaaacggaggaacttaagaactttcttaaggacctgctagagaaagcaaacaagaccgtggatgatacgaaacttgctgagtacacagacctcatgctgaagctgttcgactcaaataatgatgggaagctggagctgacagagatggccaggttactaccagtgcaggaaaatttccttcttaaattccagggaatcaaaatgtgtgggaaagagttcaataaggcttttgagttatatgatcaggatggcaacggatacatagatgaaaatgagctggatgccttactgaaagacctgtgtgagaaaaacaaacaggaattggatattaacaatatttctacatacaagaagaacataatggccttgtcggatggagggaagctgtaccgaacagatcttgcccttattctctctgctggggacaactagagttggtggccacaaccacttgctagtgatacattgtatctaaaaccataactgtgcgctataaaggagtaggctgtattttcttttatatctgtaaattctactgcatatagagaattatccaggatgtgtggcacattcttttctgcttgtttctatactgtttgtaatgtacagtttttgtaagcatataattgaaaagaagaaagtctatgcttaggccagtcagtataatccattttcaaagatgaatctaacatgattctgctttcataaatacagatgaacacttggatttccctaaaactctaccatctcaacaattctagtgtcagatgtgtaaatgcacagctgtcagtgagtaaaagaataattcatgacaagccaagtgttttttaatttaggcaatcatagaactgtcccacaaagcacttctgtgcgttttccatctagtggaagggatgtgcttctgcttgtgaagcaccaaatgtcaatagttaactatggctttatcataaaacgatctccctagagatttaatttactgatcagtggcatgtctactgcttgaatagataccacactgttggttcaagctggcttggtggcaagggaaggtagccagatgacacataaatctgtctgatactatgcctatatttccaagaagtctattgcagagagtatgaccttagcccattttctaaattattttcatgtgttccagatgacaattattctagtaaactgctgttttgtgtcatattctgtgtgtactctctgattaaattcaatgtacctctgaggcctgtcgcagttgggctccggctcctttgcggagcaccatgtcgcagagggggaggagaccctgcagggcgcctgggtagaactgcacttcagcaatgggaatgggagcagcgttccagcttccgtctctatttataatggtgacatggaaaaaatactgctggatgcgcagatgaatctggacgaagcatctccaagagctctcactgtgacagcccacctcgctcccagacaccacaagataccaacaagagctgaaatagcaccacacgtttggtgagaaaaaacagcatgtgtgtctgaggaagattatattgagagaagaagagaagttgaaagtatcctgaagaaaactcagattggatatgggattggtcaagtcggccagaaaatgttcccccc

SEQ ID NO: 1967 - DNA, 2077 bp, Rattus norvegicus
  Genbank Accession No. NM_031986
gacccacgcgtccgggagccggagcgagcggcaggaacaacgcggtgttcggggcagaaaacacctgcaaaaatgtctctctatccatctcttgaagatttgaaggtagacaaagtaattcaggctcaaactgcctcttctgctaatcctgccagccaggccttttttttaaatgtggtcgattctgctgccttccctccaggtggaaatctctatcctaaactgtatccagaactctctcaatacatgggactgtctttaagtgaagctgaaatatgtgaaaacatgcctgtggtctctggagcgccaacccaagggcagttggtagcaaggccatccagtgtgaactacatggtagcacctgtgacaggtaacgatgcggggattaggagagcagagattaagcaagggattcgggaagtcattttgtgtaaggatcaagatggaaaaattgggctcagactgaagtcagtagataatggtatatttgttcaactagtccaggctaattccccagcctccttggttgggctgcgatttggggaccaggtgctccagatcaatggtgaaaactgtgccggctggagctccgataaggcacacaaggtgctcaagcaggcctttggagagaagattaccatgaccattcgtgatagaccctttgaacggacagttaccatgcataaggacagcagtggacatgttggctttatctttaaaagtggaaaaatcacatccatagtgaaagacagttctgctgccagaaacggccttctcactgatcaccacatctgtgagatcaacggacagaacgtcattggcttgaaggatgctcagattgcagatatactgtcaacagctgggactgtggtcaccatcacaatcatgcctgcctttatcttcgaacatattattaaacggatggctcccagcattatgaaaagcctgatggatcacaccattcctgaagtttaaaccttgtacagtgcatcaccgccgaacgcttccagtcttcctcttcggcaacttctctatttcaccgcacatgaagctttcccggatccagggagactgtgctgcatggagacctgtctatcttccaccatggctgggaacctcactctatctgagagcgtcttcagattttaagataggtgtagccttatcctggttttacagatgtgaactctcaaaagattccctgactttctagacttggttctttactgggaacctgatgtttttctataagccattgtgattaggatgactggtgtaggcttagctgtgtccgagaactggtctgctttctccgagaagtgcacagtgctaggcacgtgcttcagttctgtggcatatgtggagtgtagtacatcagcatagtacctgtaggatgagtgcctttgatcgcaactttttaagtgtgtgtgtgagtgtgtaaaattccagttaatcaacacttcattcacaaaagcattatacagttctgtgtaggtggcaagagactaatgattgtcactaaattctaacaccttcacctaatgtgcttcagttgtcgcctaacacagaagcatttagataaagcaaatagaaattattgctgccttctgaaacctgagaggtagctctctatcaagctgttctatgctagccctgagcagcttactggtgtcgcagagctgcctagctgtaccaagattttctagtcactgcataaaggaaacgcctaagagttgccgtattgctttctgagatacaaattgctatatatttcatgtaaaagttgttatactaaataggataaattttggagtctcttttcactcgtagataaagtgggtaatatctaatttggcacttgagtcctaacattatgtaactttagctaggttggggtgggtttagaatgtttccctagtcatctcagtttgttccattttctgactctatcctgcaaacaaaaatggcaatgacactttatcctgactctttccttcttagtttgtgcctatcttattattttatgtgatattatcctattaaatgtataaaaatattaaaaaaaaaaaaaaaaaaa

SEQ ID NO: 1968 - DNA, 1118 bp, Rattus norvegicus
  Genbank Accession No. NM_032084
acgactggtatcagattaatgtcttgtatatctgaattccgcggaattacgcagcattcaacagagagaagagacctgggactaaaactgggattccaaaaagaatcctgcagtgtggcagcctgcttctcaccttctcacctcggagttggctgaacccagaaccaaatgctttgcacgtctcccgtcaactgcttggactcagtttgttgcacttcgataaatatctcttcactggtccgaagagctgccctcacacacaatgacaaccacttcaactatgagaagacacacaacttcaaggtgcacacatttcggggcccacactggtgtgaatactgtgccaattttatgtgggggctcatcgcccagggagtccggtgttcagattgtgggttaaacgtacacaaacaatgttccaagcacgtccccaacgactgccagcccgatctcaagaggatcaagaaagtatactgttgtgatctcaccacacttgtaaaagctcacaacactcagagacccatggtggtggacatatgtattcgggaaattgaagcaagaggattaaaatcagaagggctttacagagtctctgggttcacagaacacattgaagatgtcaagatggcgttcgacagagatggtgaaaaggcggatatctctgctaacatctacccagacataaacatcatcaccggagccctgaaactgtacttcagagacttacccatccccatcatcacatatgacacctataccaagtttatagaggcagcaaaaatctccaatgcagatgagaggcttgaagctgtccatgaggtcctgatgctgctgcctcctgcccactatgagaccctgcgctacctgatgatccatctcaaaaaggttaccatgaatgaaaaggacaatttaatgaacgcagaaaatctggggatcgtgtttgggcccaccctgatgagaccccctgaagacagcaccctcaccaccctccatgacatgcggtaccaaaagctgatcgtgcagattttaatagaaaacgaagatgttctgttttagtccatcagggaagtgcagctgatagagctagtggaataaaaacgtttctcaaaaaaaaaaaa

SEQ ID NO: 1969 - DNA, 1203 bp, Rattus norvegicus
  Genbank Accession No. NM_032615
aggtccggggctccggtccgtgccggtgcaggcgccggcatgtggctgtgggaggaccagggcggcctcctgggccccttctctttcgtgctggtgctgctgctggtggtgacgcgcagccccttcaacgcctgtgtgctcactggcagcctctacctcctgctgcggttcttcagcttcgagccggtgccgtcccgccgggccctgcaggtgctcaagccccgtgaccgcgtgtccgccatcgcccatcgcggcggcagccacgacgcgcccgagaacacgctggcggccatccggcaggcagctaagaatggagcaacaggtgtggagctggacatcgagtttacttctgatggagttcctgtcttgatgcacgataacacagtagataggacaacagacgggtctggccgattatgtgatctgacatttgaacaagttaggaaacttaatcctgcagcaaatcacagactcagaaatgagttccctgacgaaaggatccccaccctgagggaagcagttacagagtgcctctgccataacctcaccatcttcttcgatgtcaaaggccatgcagatatggcttctgctgctctaaagaatatatacatggaatttccccagctgtacaacaacagtatggtctgctcattcttgccggaagtcatctataaaatgagacaaacagatcagaaggtaatcacagccctgactcacaggccttggagcctgagccacactggagacgggaagcctcgctacagcgtcttttggaagcagtctgtgtttgtggtgttggacatcttgcttgactggagcatgcacaatgtcttgtggtacctgtgtgggatttcagccttcctcatgcagaaggattttgtctccccggactatttgaagaagtggtcagccaaaggaatccaggttgttagttggactgtcaatacctttgatgaaaagaattactacgagtcccaccttgggtccagctacatcactgacagcatgctggaaaactgtgcacctcacttctagactccccaggaggaaacacagatgcaaaactgcctggaggccttttgcagggacacgagaacactctgttagcacaagccctgggaatcctgcggctcatactagcaatagccacagttttaccccaagcagaaaccaggcatggcgaccatgctccaaggaaggctc

SEQ ID NO: 1970 - DNA, 634 bp, Rattus norvegicus
  Genbank Accession No. NM_033095
acactcaactgaaccctcccatccgacccgcaaacaacagccatggggaagatcaccttctatgaggaccgcggcttccagggccgccactatgagtgcagcacagaccactccaacctgcagccctacttcagccgctgcaactctgtgcgcgtggacagtggctgctggatgctctatgagcagcccaacttcacaggctgccagtacttccttcgtcgcggggactaccctgactaccagcagtggatgggtttcagcgactctgtccgctcctgccgcctcatcccccacgccggctcccacaggatcagactgtacgagagggaagattacagaggccagatggtagagttcactgaggactgcccctctctccaggaccgattccacttcaatgagatctactccctcaatgtgctggagggctgctgggtcctctatgagatgaccaactacagggggcgacagtacctgctgaggcccggggagtataggcgctaccacgactggggcgccatgaatgccagggttggctctctgaggagagtcatggatttctattaaattggttttttactctaccctttctccatctggaagctaataaagtattttctgtgtgttcccggca

SEQ ID NO: 1971 - DNA, 620 bp, Rattus norvegicus
  Genbank Accession No. NM_033234
tgcttctgacatagttgtgttgactcacaaactcagaaacagacaccatggtgcacctgactgatgctgagaaggctgctgttaatggcctgtggggaaaggtgaaccctgatgatgttggtggcgaggccctgggcaggctgctggttgtctacccttggacccagaggtactttgatagctttggggacctgtcctctgcctctgctatcatgggtaaccctaaggtgaaggcccatggcaagaaggtgataaacgccttcaatgatggcctgaaacacttggacaacctcaagggcacctttgctcatctgagtgaactccactgtgacaagctgcatgtggatcctgagaacttcaggctcctgggcaatatgattgtgattgtgttgggccaccacctgggcaaggaattcaccccctgtgcacaggctgccttccagaaggtggtggctggagtggccagtgccctggctcacaagtaccactaaacctcttttcctgctcttgtctttgtgcaatggtcaattgttcccaagagagcatctgtcagttgttgtcaaaatgacaaagacctttgaaaatctgtcctactaataaaaggcatttactttcactgc

SEQ ID NO: 1972 - DNA, 1266 bp, Rattus norvegicus
  Genbank Accession No. NM_033235
ctttgctggtgcagagatcggccttgcagtttgcaataatgtctgagccaatcagagtcctcgtgacaggagcagccggtcagattgcatattcgctgctgtacagcattggaaatggatctgtctttgggaaagaccagcccatcattcttgtgctgttggacatcacccccatgatgggtgttctggacggtgtcctgatggagctgcaagactgtgcccttccccttctgcaggatgtcattgcaacagacaaagaagaggttgccttcaaagacctggacgtggctgtccttgtgggctccatgccaagaagggagggcatggagaggaaggacctactgaaagccaacgtgaagatcttcaaatcccagggcgcagccttggagaagtacgccaagaaatcagttaaggtcattgttgtggggaacccagccaatacaaactgcctgacggcctccaagtcagcaccatcgatccccaaggagaacttcagttgcctgactcgattggaccacaaccgagcaaaatctcaaattgctcttaaactcggtgtaaccgctgatgatgtaaaaaatgtcattatctggggaaatcattcatcaacccagtatccagatgtcaatcatgccaaggtgaaattgcaaggaaaagaagttggtgtgtatgaagccctcaaagacgacagctggctcaagggagagttcatcacgactgtgcagcagcgtggtgctgctgtcatcaaggctcggaagctgtccagtgccatgtctgctgcgaaggccatctcggaccacatcagagacatctggtttggaaccccggagggcgagttcgtgtcgatgggcgtaatctctgatggcaactcctatggtgtccctgatgacctgctctactcgttccctgtcgtgatcaagaataagacctggaagtttgttgaaggcctccccattaacgacttctcccgtgagaagatggacctgacagcaaaggagctgaccgaggaaaaggaaacggcttttgagtttctctcctccgcatgactacacagtcgtgttgacgtcagcagacatcccaaggctgaggaatcaaaatgtcgtctttgagcctagtaccaaacagtaataatggtacattcagattgtgaacagcaaaatattttaaatattatgtgctttgtgattcgtgaaagtctatcacgttgttagtgctgcgatctaaataaaagtatattcaagtgaaaaaaaaaaaaaaaaaaaaaaaaaa

SEQ ID NO: 1973 - DNA, 783 bp, Rattus norvegicus
  Genbank Accession No. NM_033349
atgaagatcgaactactgcctgccctgaccgacaactacatgtacctgatcattgatgaggacacccaggaggccgccgttgtggacccagtgcagccacagaaggttatagaaactgtgaaaaagcaccgtgtgaagctgaccacagtgctcaccactcaccaccactgggaccacgctggtgggaacgagaagttggtgaagctggaacctgggctgaaggtttatggaggtgatgaccgcattggggccttgacccacaaggtcacacacctttccacactggaggtggggtctctcagtgtcaaatgtctgtcaacaccctgccatacttcagggcacatctgttactttgtgagcaagcctggtagctcagagccttctgctgtgttcacaggtgacacattgtttgttgctggctgtgggaagttctatgagggaaccgcagacgagatgtacaaggcgctgcttgaagtcttaggccggcttcctccagacacaaaagtcatctgtggccatgaatacaccgtaaacaaccttaagtttgcgcgccatgtggagcccggcaataccgccgttcaagagaaactggcctgggccaaggagaagaatgccatcggggagcccacggtgccatccaccctggcagaggagttcacttacaaccccttcatgagagtgaaggagaagaccgtgcagcagcacgctggagagaccgaccctgtgaccaccatgagggccatccgcagggagaaagaccagtttaaggtgcctcgggactga

SEQ ID NO: 1974 - DNA, 5531 bp, Rattus norvegicus
  Genbank Accession No. NM_033352
  misc_feature (1)..(5531): n = a or c or g or t
gagggactcgcccccggtggatgcggtggagtttgagctttttgctgcatccgtccctgaagaacaaaataagagtaagggagacaagctgcagagcatgggaggctgtggggttttctgaaacgtttgctgggctctccgcggagcatgagcttttaaaaggagttctttggagagaaatccatttgtgttagctggaaaaatgatacacatgctaaatgcagcagcctatcgggtgaaatggaccagatccggtgctgctaaaagggctgcctgcctggtggctgcggcatatgctctgaaaaccctctatcccatccttggcaggcgtttaaagcagcctggccaccggaaggcgaaagcagaagattacccgcctgcagagaacagagaaagactgcattgcacagagatcatctgtaaaaaacctgcgccgggactaaatgcagattttttcaaacagctactagaacttcggaaaatcctctttccaaaacttgtgaccactgaaacggggtggctctgcctccactcggtggctctaatctcacgaacgtttctgtctatctacgtggctggtctggatgggaaaatcgtgaaaagcatcgtggaaaagaagcctcggactttcatcatcaaactagtcaagtggcttatgattgccgtccccgctacctttgtcaacagcgctatcaggtacctggagtgcaaactggcattggcctttagaactcgcttagtggaccatgcctatgagacctattttgcaaatcagacttattataaggtgataaatatggacgggaggctggcaaaccctgaccagtctcttactgaagacattatgatgttctcgcaatcggtggctcacctgtattccaaccttaccaaaccgattttagatgtaattctaacctcctataccctcatccggacagctacatccagaggagcaagccccatcgggcccaccctgttagcagggctcgtggtgtatgccactgctaaagtcctgaaagcttgctcgcccaaatttggtactctggtggctgaagaagctcatagaaagggctacttgcggtatgttcactccagaatcatagccaatgtggaagaaattgccttctacagaggacataaggtagaaatgaagcaactgcagaagtgttacaaggctttagcttaccagatgaaccttattctatccaaacgtttgtggtacatcatgatagaacagttcctgatgaagtatgtgtggagcggctgtggactaattatggtggccatacctatcatcactgcaacaggctttgcagatggtgatctggaggatggccctaagcaggctatggttagcgatcggacagaggcctttaccactgctcggaatttactggcctctggagctgacgcgattgagaggattatgtcttcatacaaagagatcactgaactagcgggttatactgccagagtgtacaacatgttctgggtcttcgatgaagtgaagagaggcatttataagagaactgtcactcaggagcctgaaaacaatagcaagagtggaggtggcctggagctgcccctcagtgacaccctggcaatcaaagggacagtcattgacgtggatcatggaatcctttgtgaaaatgttcccataatcacgccggcgggagaagtggtggcttccagtctgaacttcaaagtagaagaagggatgcatcttttgataaccggccccaatggttgtgggaaaagctctctgttcagaatcttaagtgggctctggcctgtgtatgaaggagtcctttataaaccacctccccaacatatgttctatattccacagaggccgtacatgtctcttggaagtcttcgggatcaagtcatttatcctgactcggtggatgacatgcatgagaaaggttatacagaccgagacctagagcatattctgcacagcgtccacctctaccacatagtccaaagagaaggaggatgggatgcagtcatggattggaaagatgtcctttcaggaggggagaaacagagaatggggatggcacggatgttttaccataaaccgaagtacgcattgctggacgagtgcaccagtgctgtgagcattgacgtggaaggaaagatatttcaggctgctatcggggctggcatttccttactgtctataacgcacaggccttctctgtggaaataccacacccacctattgcaatttgatggcgaaggaggttggcgctttgaacagttggacactgctatccgcttaacgttaagcgaggagaaacagaagttggagtcgcagctcgctggaattcccaaaatgcagcagagactcaatgaactgtgcaaaattttgggggaagactcggtgctgaaaacgatccaaactgcagaggacacatcctaactgaccttgacatgttttaagttaacttctaggtgatgcctcagagactctttctttactgcatgcagtatgttaagctaagtgaagagaaagcaagccagcaaaaaaaaaaaaaaaagtattttgtatgatttcagcatcgaggaaatatgataactttttcgaatgaaaaaaaaagcgaacgaattagttgcggttagtcatgactcaggttagtgccccgtgagaggctagctcacctgtaaagtgggtttctagattaggagagtgtgtgtggttcttcctaggagagaatgccccaaaacaagacagcaggggcaccagctgggccgatgtcaggaattagacctttgagggctctttcaacccaggtaacggggacaataggtgcaacacctggaatctatagtcagcattgctaggggccaactcaaactgtgtacaaagtagcaggctgtttgatacatagtttcagtctgaaaagggtgtatccgaatgacagtggttgaaaacaagcacggctagacaagtataaagtactgtattaaattttttcataccttgagcatcttaatacagatacagaaattaacattaataaaaattgtgtgtatgtgtttaaaaaaaaacccttttatgttttaaaaagagaattgcccatacagaagaggacggtctgaacgatatttgttctggctaccgcttgactctgcagtcctatttagtacggtttctgtccagaaatactgtctgtctggtgcccaaaatggcattttagaaacttgattgctgccctaaatatggatcctggaaatcacagttatgttcctacattcattttaccttactccatcttttaagacatacaagtttttgttcctttttcttctgaaacgcgcgcgcgcacacacacacacacacacacacacacacacacacacacacacacagatttactttaatcacatgatttattttggaagagctgtagcgatcatgaaggtctccctcccccacacaccagacccagtgctgtcatcactaatggcccttaaatttaactgggatataatgtcagttttaaaangatgtggaccaggcagatggccagaaatggttgtaggcaaagcagggcataagggaaaaaattaaagcagataaataaatattattcaggcatagaagagtgacagttgcttctcttgtaggggacctgagttccattgccaacatccacatggtggctcaaacgtgtgtctaattccagctccaggggatctgacatacatgtagactccagggatcctgcatacatgtagtcctcatacacacatacatgcagacaaaacattcatagcattaaaaatcaataaatctgaaagatagtaaggatattgaaagctggcaatgttgatgttaccatcacttaattactgtttgcgagaagtgaaaattgagtgagaaatgcaatgggcgttggtcaacgcagctcggctgtgcacacccacctgatgccgaagtgtctgcagtgccagcgctcaggagggcagtacattgcacttccggtaagcttcacgctgctgaagatgacagagaccctcacatcatatgaaatacagtgcatctggagtacaaaaccacgactaatgctttaatctcatcctctctcagacatgacgaggtatgtgaaaacccgagatgaacagttttaggggcttaaggttttgtttctgtattcagacagcgctttagcagacactaactctcgataacagacggtttggaagacagaccccctagaagtcattcacaatgatggtcgtgagaaattgcagcatttccacattttcaattccgcaaaaatctacacaatttgaattaccaatcactgtgaccaccttacacaaaacaatacaaggtcataatcagtacctttgtatttgtctgttactgctacttcttactaataatgtgggacactaatgaaatatttggtttagcaaaagtataaaaccagaaattgacactgaattaaaaaaaaaaacacacaattcactaatctcttaacaaccgtgctagcagttacccaggttatagtgctaaaggagaatcatttgaagcaagggtcttatattagctctgacaagcacaagaggaaaattgaaagttcacatttgaaattataccatttcagacttaaaataaaccatgtaagacctgatatcctacgttttcaagctttgcgaaagatgccaacatcaatgctacattcggaactagaccttatttagtagaggttaccagcgagctggatcgaaataaataagactcgttacacagtggatgggggttcaacgatgtttggaattcggtactaaaactctagtcacgaaatttaaacgttaaggtttcaggactaactgtttcccagtagccttttggtaactactgatttaatgctggatatctttttttttcttttttttctttttttttccagagctggggaccgaacccagggccttgcgcttcctaggcaagcgctctaccactgagctaaatccccaaccccactactgattttctgaactgcctcttctgagccagagtaccctccgtcttagagggagaacccgatgtggatctgtgttgtgtataatctgactctttccaaagtgctcccacgggagaccagagctgatactctgacaggcatacttgtgaaaacacaaagaccactgagacctcttctttgactaggacaaagaataataaggaagacgaaggatagcttcatctgtcaaactactttttttttccttagaaaaggcataaatgtatggagttcgattatttcggggaataactcaaaacctgcattgtgacatccgatctctggagcatgctatggtatgccaagcacccaagcacactgtgttcactcttacagacgagataattgctaaaatcctcttgagtcacaaggtcggtgatcgtacttgaaaaccagcccagttcaccctatgtttacacgggaagagttttcctttgatagcaatttgacttttgacccaaattttggcgtgtcaataaaggtataagc

SEQ ID NO: 1975 - DNA, 2563 bp, Rattus norvegicus
  Genbank Accession No. NM_052798
cggaacagtctaagggtgttcactttggggactcagtgagtccccctctgttatggagtacagtgtctcttgaatcttacttctggaaatccacggacaagaagactggtgacctatcgattttgtgatgcccacccctggctcctggttccctctctagaggcagaagagccaggcgcagctaatgggacgctttcggagatgctgcgtctgacaggtgcgaagcaacatgtgcaactcctttcttcttcctcccctcagatcctcctccatcttcacccatctttagaggaagagcctacagaaagaagatggctcctgagcaaagagaaggggcctctcaggtgtcagtgacatttgaagatgtggctgtgctctttactcgggacgagtggaagaagctggatctgtctcagagaagcctgtaccgtgaggtgatgctggagaattacagcaacctggcctccatggcaggattcctgtttaccaaaccaaaggtgatctccctgttgcagcaaggagaggatccctggcaggtggagaaagagggccccagatacttctctctcggattgaagtgcagtcatagaaccactaagtcaactcaaacacaagactcttcatttcaggaactgattgtaagaaaatctaaaagaacctttgccttcgaacctttgaacatgaagtcagaaaatcttttcatacatgaaggcaaattagaggaaaagtgggataagaatactttgactgtagaaagaagccataaaaacaatgaatttagcccaaagtcccatagagaaaaacggtcctcagaatgtaaaaagcagatatcttatttatctaacccaccaggaatcacaccggataaacgctataaatgtagcatgtgtgagaaaaccttcattaacacctcatctcttcgcaaacatgagaaaaaccatagtggagagaaattatttaaatgtaaagaatgttcaaaagccttcagccaaagttcagcccttattcaacatcaaataactcacactggagagaagccttacgtatgtaaagaatgtgggaaggccttcactctcagtacgtccctgtataaacatctcagaacccacactgtggagaaatcctacagatgtaaggaatgtggtaaatcctttggccaaaggtcaggtctttttatacaccagaagatccatgcccgagaaaaccctcatagatataacccaggaaggaaggcatccgcttccctctctggatgccagagagctcattccaggaagaagacctacttgtgtaatgaatgtggcaacaccttcaagtctagctcctccctccgttaccatcagagaatccacaccggagagaaacctttcagatgtagcgaatgcggcagagccttcagtcagagcgcatcacttattcagcacgaaagaatccacacgggagaaaagccctacaggtgtggcgagtgtgggaaaggcttcacttctatctcaagactcaatagacaccggataattcatacaggagagaaattgtataattgcaatgagtgtggcaaagccttaagttcccactcaactcttattattcacgaacgaatccacactggagagaaaccgtgtaaatgtaaagtttgtgggaaagccttcagacagagttcagctctgatccaacatcagagaatgcacactggggaaagaccctataaatgtaatgagtgcgggaaaacattcaggtgtaactcatccctaagtaaccaccagcgaatccacactggagagaaaccttatcaatgtatagaatgtgggatgtcgtttggacaaagttctgctcttattcagcaccgaaggattcacacgggagagaaaccgtttaaatgtaacacatgcggaaagacctttaggcagagctcctcacgtatagcacatcagcgaattcatactggggagaaaccctacgaatgtaacacgtgtgggaaacttttcaactataggtcatcccttaccaatcattataaaatccatgtggatgaggacccttaaaaagtaaatttgcatgtaaaaaagccttaaaccaaagctcttcagagaatgggcttgagagctgtaataaacatactatggcgtccctgtagtcatttagttactgtcaactaaattccatggataaatcctgtgtaacaggtaggagtgaaatattcatgcctgtccaacactttaaaaaaattgcttgaaatccggtggttatgtgtagtcctggctaccggggaccctgaggattgcttgactccacaagtttgaagagcaaatgttatggagctttccatctcagaagattagtgacctgaaatgaagaattcacagctgaaggccttgacttcaggtatttggaaaatggtgcttttctctctgcaacagtgtgtgctagatacaattgtaatcataggcatctaagtgaacagaggagtgggatggacttagcaaaacacaaaactctactgttgtgatacttttatactattttaataatatccaaaagggatcaacacaaatcaaaaaaaaaa

SEQ ID NO: 1976 - DNA, 1458 bp, Rattus norvegicus
  Genbank Accession No. NM_052809
gagggtttaggctggtctccggtgacctcctagtcctaaatcttgatacccttgcaagagctttgagcgtgtggggtcccgggcgttcggggtcccgggtgtgtgcggtttgtatagcctgaagccggggtcctccgcgctcgcgtcctccgcagctggactgaagagacgcgtcccagccctgcggggatggaacggaccgagctgctgaagccccggaccctggccgacctcatccgaatcttgcatgagctcttcgccggggacgaagtcaatgtggaggaggtgcaggctgtgctggaagcctacgagagcaatcctgccgagtgggctttgtatgccaaattcgatcaatacaggtatacccgaaaccttgtggatcaaggaaatgggaagtttaatctgatgattctgtgctggggtgaagggcatggcagcagtattcacgatcacacggactcccactgctttttgaagctgctgcaaggaaatctaaaggagacattgtttgactggcctgacaagaaatccaacgagatgatcaagaagtctgaaagaactttgagggaaaatcagtgtgcctacattaatgattctattggcttacatcgagtagagaacgtcagccacacagagcctgctgtgagccttcacttgtacagtccacctttcgatacatgccatgcctttgaccaacgaacagggcataaaaacaaagtcaccatgacattccacagcaaatttggaatcagaactccatttacaacttcaggttcactggagaacaactaagacctgccaagcctttcaaagttttgcttctgggtcgttggaatgttttaccttggataagagaggccacccatcatttgctgtccagttatacattttaataagtccatgctcagtgtgtatactaaggaagcaaaccatcccctgagctatgcaggagaaaaatcccactaaagaaaaagtcacttgatttttaatagccaaatcaccttgctcccagttcttctgtcttctaactccatggaaattctattgggagttctcagtggggttttttttcaaccttaggaaagcacttctggtctctgaactctaataatcaataagtaaaaatgaagaaaccacaagctatcacatgtctgttttcatacctggaagtctaagtgtggaaatctttaatttactttgtatgttcttaatgtttgacaagaatttttttaaatcttggttttcagttttttcaaccctgtttgacaaattcctatgctgtggagactagggatgcagatagcagtttggtgtttggtagtgaacagcagtggggccagaaatgtgcatgtatccagacctcctgcaaataaaaactgaaactcatgtgtaatgtgtgccaccaccttaagctgccaccaaaattgccaaacgactttaataaaactggatttgaga

SEQ ID NO: 1977 - DNA, 1973 bp, Rattus norvegicus
  Genbank Accession No. NM_053297
cggcagcgacccgtcctaagtcgacagacgtcctctttaggtattgcaacaggatctgaagtacgcccgaggatctcagaaaccatgcccaagccagacagcgaagcagggactgccttcattcagacccagcagctccatgcagccatggctgacaccttcctggaacacatgtgccgcctggacattgactccgcacccatcacggcccgcaacactgggatcatctgtaccattggccctgcttcccgatctgtggagatgctgaaggagatgattaagtctgggatgaatgtggctcggctgaatttctctcatggaacccatgagtaccatgcagagactatcaagaatgtccgtgcagccacagaaagctttgcatctgatcccattctctaccgacctgttgcggtggctctggatacaaagggacctgagatccggactggactcatcaagggcagcggcaccgcagaggtggagctgaagaagggagccacactgaagatcaccctggacaacgcctacatggagaagtgcgatgagaacatcctgtggctggactataagaacatctgcaaggtggtggaggtgggcagcaagatctacgtggacgatgggctcatctccctgcaggtgaaggagaaaggtgctgactacctggtgacagaagtggaaaatggtggctccttgggcagcaagaagggcgtgaacctgcctggtgctgctgtggacctccctgctgtgtcagaaaaggacatccaggacctgaagtttggggtggagcaggacgtggacatggtgtttgcgtctttcatccgcaaggcggctgacgtgcatgaggttaggaaggtcctgggagagaagggcaagaacatcaagatcatcagcaaaatcgagaaccatgaaggtgtccgcaggtttgatgagattttggaggccagcgatggaatcatggtagctcgtggtgacctgggcattgagattccggcagagaaggtcttcctagctcagaagatgatgattggacgatgcaaccgagctgggaagccagtcatctgcgccacccagatgctggagagcatgatcaagaagccacgccccacccgtgctgaaggcagtgacgtggccaatgcagtcctagatggagctgactgcatcatgctgtccggagaaacagccaaaggggactaccctctggaggctgttcgcatgcagcacctgatagctcgagaggctgaggcagccgtgttccaccgcctgctgtttgaagagcttgcgcgagcctccagtcaatccacagaccccctggaggccatggccatgggcagcgtggaggcctcttataaatgtttagcagcagctttgatagttctgacggagtccggcaggagtgctcaccaagtggcccggtaccgcccaagggctcctatcattgctgtgacacgcaatccccagacagcccgccaggcccatctgtaccgtggcatcttccctgtgctgtgtaaggatgccgtactggatgcctgggctgaggacgttgatcttcgtgtgaacttggccatgaatgttggcaaggcccgaggcttcttcaagaagggagatgtggtcattgtgctgactggatggcgccctggctctggcttcaccaacaccatgcgtgtagtgcctgtaccatgatgatcctctggagcttctcttctagcccctgtcccttcccctcccctatcctatccattaggccagcaacgcttgtagtgctcactctgggccatagtgtggcgctggtgggctgggacaccaggaaaaattaatgcctctgaaacatgcaatagagcccagctatttttcatggccctacttgagccaggggtgaaggaggaatgcaggattggaaaccctctgactttatcacagaagggcagcattatctctgtgttctttgctcctgtagaaagttttccagagaattc

SEQ ID NO: 1978 - DNA, 684 bp, Rattus norvegicus
  Genbank Accession No. NM_053299
ggagctactcacatataagcagacatgaggactcttttctcactcggcctctgactgcagacatggcttcctgcgtctgtgttgtccgttcggagcaatggccattaatgacctttgacaccaccatgagtgacaaagtgaagaaaatcaatgagcatattaggtcccaaaccaaggtctctgtgcaggaccagatccttctgctagactccaagatcctcaagccccatagagcgttgtcatcttatgggattgacaaggaaaacactatccacctcaccctaaaggtggtgaagcccagtgatgaagagctgcccttgtctctggtggagtcgggcgacgaggggcaaaggcacctccttcgagttcgaagatccagctccgtggcccaggtgaaggaaatgatcgagaatgtgaccgctgtgcctcccaagaagcagatcgtgaattgcaatggaaagaggctggaagatggaaagatcatggccgactacaacatcaagagtggtagtttgctctttctcacagcgcactgcattggggggtgactacgggagtggggtgatgagaagctcaaaaccgacttcctttaatcaattaaccaattgcatctcttgatgatataaaaaataatgagaatgaaataaagatttgaggtggggtgagtaaaaaaaaaaaaaaaaa

SEQ ID NO: 1979 - DNA, 1207 bp, Rattus norvegicus
  Genbank Accession No. NM_053310
tgactcctgtcacccctctgggtgtcccttagaggtcatccagcccagcctgaccaatgtccacagccagggaacagccaatcttcagcaccagggcgcacgtgttccagatcgaccccgctacgaagaggaactggattcccgctggcaagcatgcacttaccgtgtcctatttctatgatgcaacccgaaatgtgtaccgcatcatcagcatcggaggcgccaaggccatcatcaacagcacagtcactcccaacatgaccttcaccaaaacctctcagaagttcgggcaatgggcagacagtcgagccaacactgtgtatggcctaggctttggctcggaacagcagctgacccagtttgctgagaagtttcaggaggtcaaagaagctgccagactggctcgggagaaatctcaagatggtggagaactcactagtactgccctggccatggcctcccaccaggttcctccaagccccttggtcagcaccaatggtccagaagagaagctgttccgcagccagagcgcggacgcccctggccccactgagcgggagcggttgaagaagatgctgtcagaaggctccgtaggggaggtccagtgggaggctgagttctttgcacttcaggacagcaaccagaggctggcaggggcccttcgagaggccaacgcggccgccactcagtggaggcagcagctggaggtccagcgtgcagaggctgaacacttgcggcagcgggtggctgagctggaggcccaggtggctgcagagccggtccgggcaggagagaaagaagcaaccagccagtcggtggagcagctggaggctcgggtgcagaccaaggaccaggagatccagactttgaagaatcagagcactggcccacgagaggctcctgacaccgccgagcgggaggagacacagcagcaggttcaggacctggagacccggaatgcagaactggagcagcagctgcgggcgatggaaagcaacctggaggaggcgcgggccgagcgggagcgcgcacgagcagaggtgggccgggctgcgcagctgttggacgtgcggctgttcgagctgagcgagctgcgcgagggcctggctcgcctggcagaggcagcaccctagtttgctctggaggcctgcggccccaaggcaccctggcagggaccagggggccccagctgtctctgagctttgca

SEQ ID NO: 1980 - DNA, 4228 bp, Rattus norvegicus
  Genbank Accession No. NM_053311
tgtggagaagaagggagcgtcggaccggaacggatgtatacatctcaagattgagaggaagaaacaagtcatgggccagtggtcaagatacttctctgggaattgttgctgctgataactgctttaccaagtcatacaatgagtgtttggtttaaggaagattttaatatttaaaagattttcatcttggaaaattgatcaagtgaagatttcatttctttttttttttgggaaacattttcctcctcataaattacccttgtaatgggcgacatggcaaacaactcagttgcatatagtggtgtgaaaaactctttgaaagaagctaatcatgatggcgactttggcatcacacttgccgagctgcgggccctcatggagctcaggtccacagatgcattacgaaaaatacaggaaagctatggggatgtctatggaatttgcaccaagttgaaaacatctcccaatgaaggtttaagtggaaatcctgcagatttagaaagaagagaagcagtgtttggaaagaactttatacctcctaagaagccaaaaacctttcttcagttagtatgggaagcattacaagatgtcactttaattatactagaaatcgcagccatagtatcattgggcctttctttttatcaacctccggaaggggataatgcactttgtggagaagtttctgttggggaagaagaaggtgaaggagaaacggggtggattgaaggagctgccatcctcttgtcggtggtgtgtgtggtgttagtgacggctttcaatgactggagtaaggagaaacagttccgaggcttgcagagtcgaattgaacaggaacagaagttcaccgtcatcaggggtgggcaggtcatccagatacctgtagctgacattactgttggagacattgcccaagtgaagtacggtgatcttcttccagctgatggtatattgattcaaggcaatgaccttaaaattgacgagagttcgttgactggcgagtctgaccatgttaagaagtctctagataaagaccccttgcttctttcaggtactcatgtaatggaaggttctggaaggatggtcgttactgctgtaggtgtgaactctcaaactgggatcatctttaccttacttggagctggaggcgaagaggaggaaaagaaagatgagaagaagaaagaaaagaaaaataagaaacaagatggagctattgaaaatcgcaacaaagcaaaagcccaagacggcgcggccatggagatgcagcctctgaagagtgaagaagggggagatggtgatgagaaagacaagaagaaagcaaatctgccaaagaaggaaaagtctgtgttacaagggaaacttacgaagctggctgttcagattggcaaagcaggtctgctgatgtctgccatcacggttatcatcctagtgctatattttgtgatcgataccttctgggttcagaagaggccgtggcttgctgagtgcacgccaatctacatccagtactttgtgaagttcttcattatcggggtcaccgttctagtggtcgcggtgccggaaggcctcccgctggccgtcacgatctcactggcttactccgtcaagaaaatgatgaaggataacaacttggtgaggcacctggacgcttgtgagaccatggggaacgctacagctatctgttccgataagacggggaccctgacgatgaacaggatgacggtcgttcaggcctacatcaacgaaaagcattataaaaaggttccggaaccagaagccatcccgccaaatatcctgtcctatctggtaacaggaatttctgtgaattgtgcttatacatcaaaaatattgccaccggagaaagagggtggattacctcgtcatgtggggaataaaacagaatgtgccttgttgggatttctcttggatttaaagcgggattatcaagatgttagaaatgaaataccagaagaagcattgtacaaagtctataccttcaattctgttaggaaatccatgagtacagtcctaaagaattcagatggaagtttccggatcttcagcaagggtgcatctgagataattctgaaaaagtgtttcaaaatcttgagtgctaatggtgaggccaaagtgttccgacccagagaccgagatgacattgtgaagacggtgattgagcccatggcatctgaaggcctgagaaccatatgcctagcgttcagagacttccccgcaggagagccagaaccagagtgggataacgagaacgatgtcgtcaccggccttacttgcatcgctgttgtggggattgaagatcctgtgaggcctgaggtaccagaggcaataaagaaatgtcagagggctggaattaccgtgcgcatggtcactggtgataatattaacacagctcgggccattgctaccaaatgcggtattttacacccaggggaagatttcctgtgcttagaaggtaaagattttaaccgaagaatacgaaatgaaaaaggagagattgaacaagagaggatagacaagatttggccaaagcttcgagtgcttgcaagatcatctcccactgacaaacatacactggttaaaggtataattgacagcacagtctcagagcaacgccaggttgtagctgtgacaggggatggtacaaatgacgggcctgcgctgaagaaagcagacgttggctttgcaatgggcattgctggaactgatgtggctaaagaagcatctgatatcattctcacagatgacaacttcacaagcattgttaaagcggttatgtggggacggaatgtctatgacagcatctcaaaattccttcagttccagcttactgttaatgtagtggccgtgattgtcgctttcacgggcgcttgtattactcaagactcgccactgaaggcggtacagatgctctgggtcaacctcatcatggacacgctggcctccctggctctggcgacagaaccacccaccgagtcactcctgctccggaagccttacgggagaaacaagcctctcatctcacgcacaatgatgaagaatatcttgggccatgcgttctatcagctcgtagtggtcttcacgctcttgttcgctggagagaagtttttcgatatcgacagtgggaggaacgcccctctgcatgctccaccgtcagagcactacaccattgtgttcaacacctttgtgctgatgcagctcttcaatgaaataaatgcccggaaaattcatggggaaagaaatgtgtttgaagggatcttcaacaacgccatcttctgcacaattgtcttaggcacctttgtggtgcagataataatcgtgcagtttggcgggaagcctttcagctgctcagaactttcaatagaacaatggctgtggtccatattcctgggaatggggaccttactctggggccagcttatttcaaccattccaaccagccgcttaaagtttctaaaagaagctggccatgggacacagaaggaagagatccctgaggaggaattggcggaggatgttgaagagattgaccatgccgaacgggagttgcggcgtggccagatcttgtggtttagaggcctgaacagaatccaaacacagatggatgtagtgaatgctttccagagtggaggttccattcagggggctctaaggcgacaaccctccatcgccagccagcaccatgatgtaacaaatgtttctacccctacacatgtagtgttttcctcttctactgcttctactcctgtggggtatccgagtggtgaatgcatttcgtagctctttatacgaagggttagagaagccagaatcaagaagttcaatccacaactttatgacacaccccgagtttaggatagaagattcagagccgcacatcccccttatcgatgacactgatgctgaagatgacgctcctactaaacgcaactccagccctccgccctctcctaacaaaaataacaatgccgttgacagcgggatccaccttacaatagaaatgaacaagtctgctacctcttcgtccccagggagcccactgcatagtttggaaacatcactctgattgtaagctgaacgttaacacactagccgcactgtaaagaaacaaattgaaactgagtcttttcacacattgtgacggacaagatggcgttcttgtctccggacttcaacagaagacacacttgtacgaatgtagatttattttttt

SEQ ID NO: 1981 - DNA, 505 bp, Rattus norvegicus
  Genbank Accession No. NM_053319
ggagagcggccgcgctgtcgcctctgctgcttgagcggcgccagcaccttccctaggagctcgcagcagccggctggcccctgctccacggtaaccatgtgcgaccggaaggcggtgatcaaaaatgcagacatgtcggaagagatgcaacaggactcggtggagtgcgctactcaggcgttggagaagtacaacatagagaaggatatcgcggcccatatcaagaaggagtttgacaagaagtacaaccccacctggcactgcatcgtgggccggaacttcggtagctacgtgacacacgagaccaaacacttcatctacttctacctgggtcaggtggccattctcctgttcaaatctggttaatagcatggactgtgccaaacacccagtgatccatccaaaaacaaggactgcatcctaaattccaaataccagagactgaatcttcagccttgctaagggaacacctcgtttgaatctgttgtgttttgtacagggcacc

SEQ ID NO: 1982 - DNA, 1812 bp, Rattus norvegicus
  Genbank Accession No. NM_053329
atggccctgaggacaggaggcccagccctggtggtgcttctggctttctgggtggcactgggcccctgtcacctgcaggggacagatcccggagcgtcggcagatgccgagggcccccagtgccccgtcgcctgtacctgcagccatgatgactacacagatgagctcagcgtcttttgcagttcaaagaacctcacacatctgcctgatgacatcccagtcagcaccagagccctgtggcttgatggcaacaacctctcttctatcccctcagcggccttccagaacctgtccagcctggactttctcaacctgcagggcagctggctgaggagcctggagccacaggcactgctggggctgcagaacctctactatctgcacctggaacggaaccggctccggaacctcgccgtgggcttgttcacacacacaccgagtctggcttcactcagcctgagcagcaacctcttgggccggctggaggaagggctgttccagggcctcagtcacctttgggacctcaacctgggttggaacagtctagtggtcctgcctgacacagtgttccagggactgggcaacctccacgagctggtgctggctggcaacaaactgacttacctgcagcctgcgctcttctgtggcttgggcgagctgcgggagctggatctgagcaggaacgcactccgaagcgtcaaagctaacgtctttgtacatttgcccaggctgcagaagctgtacctggaccggaacctcattacagccgtggcccctcgtgcctttctgggcatgaaggccctgcgttggctggacctgtcgcacaaccgcgtggctggcctcatggaggacaccttcccaggcctgctgggcctgcacgtcctgcgcctggcacacaatgcgatcgctagcttgcggccgcgcactttcaaagacctgcacttcctggaggaactgcagctgggccacaatcgaatcaggcagctcggggagaggacattcgagggcctggggcagctggaggtgctgacgctcaatgacaaccagatcactgaggtcagggtgggcgccttctctggccttttcaatgtggcggttatgaatctctccggcaactgtctgaggagcctcccggagcgggtgtttcagggtctggacaaactgcacagcctgcacctagagcacagctgcctgggtcacgtccgcctgcacacttttgctggcctctcagggctgcgcaggctcttcctcagggacaacagcatctccagcatcgaagaacagagcctggcagggctttcggagctcctggaactggatcttactaccaaccgcctcacacatctgccccgccagctcttccagggcctcggccacctggagtacctgcttctctcctacaaccaactgacgactttatccgcggaggtcctgggccctctgcagcgggccttctggttggatatctcacacaaccacctggagacgctggccgaaggccttttctcatctctggggcggcttcgctacctcagcctcaggaataactccttgcagaccttttcaccacagcccggcctggagcgcctgtggcttgatgccaacccctgggactgcagctgtcccctcaaggcgcttcgagactttgccctgcagaaccctggtgttgtcccccgctttgttcagactgtctgtgagggggacgactgccagccggtgtacacctacaacaatatcacttgcgctggccccgccaacgtctcgggcctcgacctaagagacgttagtgaaacacattttgtgcactgctga

SEQ ID NO: 1983 - DNA, 554 bp, Rattus norvegicus
  Genbank Accession No. NM_053330
ctttccgccggggcagccatcttccagtaactcgccaaaatgacgaacacaaaaggaaagaggaggggtactcggtatatgttctctagaccttttaggaaacatggagtcgttcctttggccacatacatgcgaatctacaagaagggtgatattgtagacatcaagggaatgggcactgttcaaaaaggaatgccccataagtgttaccatggcaaaaccggaagagtctacaatgtcacccagcatgccgtgggcatcattgtgaacaagcaagttaaaggcaagattctggccaagaggatcaatgtgcggattgagcacatcaagcactcaaagagcagagacagcttcctgaagcgggtgaaggagaacgatcagaagaaaaaggaagccaaagagaagggcacctgggttcagcttaacggccagcctgcgccacccagagaagcccactttgtgaggactaacggaaaggagcctgagctgctggagcccattccatacgaattcatggcctaatgtatacaaaggaaataaagaacccgaactgc

SEQ ID NO: 1984 - DNA, 10872 bp, Rattus norvegicus
  Genbank Accession No. NM_053332
atgtcctcgcagtttctctggggttttgttactttgttgatgatagctgaattagatggcaaaactggaaagccggagcagaggggacagaaaaggatcgctgacctgcaccagcctcggatgactacggaggagggaaacttagtatttcttacaagctctacccaaaacattgaatttagaactggatccctggggaaaatcaaattaaatgatgaagaccttggcgaatgtttacaccagatccagagaaacaaagatgatattatagatttaagaaagaatacaactggcctccctcaaaatatacttagtcaagtccaccaacttaactcgaagctcgtggatctggagagagattttcaaaacttacagcagaatgtggagagaaaagtttgcagtagcaatccctgccttaatggtggcacctgcgtcaacctgcacgactcctttgtgtgtatctgcccttctcagtggaagggtctcttctgctcagaggatgtcaacgagtgtgtagtttactcaggaacaccctttggctgccagagtggatccacctgtgtgaacacagtggggagtttcagatgtgactgcacgccggatacgtacggacctcagtgtgcatccaaatataatgactgtgaacagggctctaaacagctctgcaagcacggcatctgtgaggatttacagcgagttcaccatggacagccgaattttcactgcatctgtgatgctgggtggacaacaccgccaaatggaatctcctgcacagaggacaaagacgaatgcagcctccagccttcaccttgttcggagcatgcgcagtgtttcaatacacaaggctccttctactgtggggcctgccccaaaggttggcagggaaatggttatgaatgccaggatatcaatgaatgcgagatcaacaatggaggctgttcccaggcgccactggtcccatgcctgaacacacctggatcattctcctgtgggaactgtccagcaggtttcagtggtgacgggagagtgtgcactcccgtggacatctgttcgatccacaatggaggctgccatccagaggcaacctgctcctcatctcctgttctagggtccttcttgcctgtctgcacctgtcctccgggatatacaggaaatggttacgggtctaatggatgtgtacgcctcagtaatatttgctcaaggcacccgtgtgtaaatggacagtgcatagaaacagtatcaagttatttctgtaagtgtgactcaggctggtctggacagaactgtacagaaaacattaatgactgttcgagcaacccctgtttgaatgggggcacctgtattgatggcatcaatggcttcacctgcgactgcacaagctcttggactggctattactgtcagactccccaggcagcttgcggagggatcctctcagggacacaaggaacctttgcctaccacagcccaaatgatacctatattcacaatgtgaactgtttctggattgtcagaactgatgaggaaaaggttctgcatgtcaccttcacgttttttgatttagaatcagcaagcaattgtccccgggagtaccttcagattcatgatggagactcctcagcggatttcccacttggtagatactgtggctccaggcccccccaggggatccacagcagtgccaatgctctctatttccatctctactccgagtacataaggagtgggagaggctttacagcaaggtgggaggcgaagctgccagagtgtggcggcatcctgactgataattacggttctattacgtctccggggtaccctggaaactaccccccaggaagagattgtgtctggcaggttttagtcaatcctaactccttgataacatttacctttggaaccttgagcctggagagccacaatgactgcagcaaagactatttggagattcgagacggtcctttccaccaagaccctgttcttgggaaattctgcacttccttgtctaccccacccctcaagactaccggtcctgcagcaagaattcatttccattctgactctgagaccagtgacaaaggcttccacatcacctatctaaccacacagtcggatctggactgtggtgggaactacacagacacggatggcgagctcctccttcctcctttgtctggtcctttcagtcacagcagacagtgtgtctatctcatcacccaagcccagggagaacaaatagttatcaacttcacccatgtggagctggagagccagatgggctgttctcacacttacatcgaggttggagaccatgacagcttacttcgaaagatctgtggcaatgaaaccttgttccccattagatcagtttctaataaagtctggatcagattgagaatagacgctttagtccagaaggctagtttcagagctgactaccaagttgcttgtgggggtatgttaagaggagaaggattctttcgctcacctttctatcctaacgcatatcctggacgaagaacctgtaggtggaccatctcccaaccccaaagacaagttgtccttcttaacttcactgactttcagatcggaagttctgcctcctgtgatacagattatattgagattggtcccagctctgtcttgggatctcctggaaatgagaagttttgtagctcaaacataccgtcatttataacatctgtatacaatattctttatgttacatttgtgaaaagttcttccatggaaaatcgtggcttcacggctaagttcagcagtgacaaactagagtgtggagaagttctcacggcatctacaggaattatcgaaagtccaggtcatccaaacgtctacccaagaggtgtaaattgtacttggcatgtagtagtccaacgcggccaactgatccgtttggagttcagttccttttacctggagtttcattacaactgcacaaacgactacctggaaatttatgacactgccgctcagacttttcttgggagatactgtggaaaatccatcccgccttctcttaccagcaactctaattcaataaagctgatatttgtgtctgactccgcccttgcccacgaaggcttttccataaattatgaggcaatcgatgcatcatcagtatgtttatatgactatacagataattttgggatgctctcctccccgaacttccccaataattaccccagtaactgggagtgcatctacagaatcactgtgggactcaaccaacagattgcattgcatttcacagacttcaccttggaggactattttgggtcacagtgtgtagattttgtagaaatcagagacggaggctacgaaacgtcgccgcttgttgggatttactgtggctcagttttgcctcctacaatcatctcccacagtaacaagctctggctaaagtttaagagtgacgccgcactcacggcaaaggggttctcagcgtactgggacggatcatcaacaggctgtggaggtaatctcaccacccccacaggggtgctcacatcgcccaactacccgatgccctactaccacagctccgaatgctactggcggctggaagccagtcatggcagccctttcgagctggaattccaagacttccacctggaacaccaccccagctgctctctggattacttggccgtgtttgatggcccgactaccaactcccgactgatagataaactgtgtggggatacgacacctgctcccatccgttccaataaagacgtcgtattgttaaaactgaggactgatgcaggtcagcaaggccgtggctttgagatcaacttccggcagagatgtgacaatgtggtgatagtgaacaaaacctctggcatcctggagagcataaattatccaaatccctatgataagaaccaacgttgtaactggaccatccaagcaaccaccggcaacaccgtgaactacacgtttctgggatttgatgtggaaagttacatgaactgctccacagattatgtagagctctatgatggaccacaatggatgggacgctactgtggaaataacatgcccccaccaggggctacaacaggctcccaactccacgtactgttccatacagatgggatcaattctggggaaaaaggatttaagatgcagtggttcactcatggctgtggtggagagatgtctggaaccgcaggctccttcagcagccctgggtaccccaacagctatcctcacaacaaagagtgtatctggaacattcgcgtggccccagggagtagcattcagctcaccatccatgactttgatgtggaatatcatacaagctgcaactatgactccctggagatctatgcaggtcttgattttaactctccaagaatagcccaactgtgttcccaatcaccgtcagcgaaccccatgcaggtctccagcactggcaatgaactagcaatccgatttaagacggatagcactttaaatggaagaggtttcaatgcctcgtggcgagcagtccctggaggttgtggtggaattatccagctttccagaggagagattcattctccaaattaccccaacaactacagagctaacacagagtgctcctggatcattcaagttgagcgacatcaccgtgttctcttgaatatcactgactttgaccttgaagctccagattcttgcttacgacttatggatggctcaagttccacaaacgcccgtgtcgccagtgtgtgtggaagacagcagccccctaactctatcatcgcttcaggaaacagcctctttgtgagattccggtctggatcttccagccagaacaggggcttccgggctgaattcagggaagagtgcggaggccgcatcatgaccgactcttccgatactatcttctctccactgtaccctcacaactatctacacaaccagaactgttcctggataattgaagctcagcctccattcaatcacattactctctcctttactcactttcaacttcaaaacagcacagactgtacacgggactttgtagaaattttggatggcaacgactatgacgcacctgtccaaggccgttactgtggtttctccctgccccaccccatcatatcatttggcaatgccctaaccgtgaggtttgtcactgattccacacgcagttttgagggtttccgtgccatctattctgcatcgacatcatcttgtggtggaagcttctacacacttgatggcatcttcaatagccccgactacccagcagactaccatccaaatgcagaatgtgtctggaacattgccagctcccctggcaaccgcctgcaactgtccttcctatccttcaatttggagaattctctaaactgtaacaaggattttgtggaaatccgagaaggaaatgccacgggccacttgattggacgatactgtggaaactccctccctgggaattattcgtcagctgagggacatagtctatgggtccgatttgtctctgatggctcaggcactggcatgggcttccaggccaggttcaaaaatatatttggcaataataatattgtgggaactcatgggaaaatcgcatctcccttctggcctggaaaatacccctacaactccaattacaaatgggtggtaaatgtggacgcatatcatattatccacggtagaatcttagagatggacatagaacccacaacgaactgcttttatgacagtttaaagatttatgatggatttgacactcattcccgtctcattggcacttactgtggtacccagacagaatcctttagctccagtagaaactctctgacattccagttttcttccgactcttctgtgtcaggaaggggattccttctggagtggtttgcagtagatgtttctgatagcacccctcccaccatcgctccaggagcttgtggagggtttatggtgacgggagacactcctgtccatattttctccccgggttggcctagagagtatgctaatggtgctgactgtatctggatcatctatgctcctgactctactgtggaactcaacattctctccttggacatcgaaccgcagcagtcatgcaattatgacaagctgatcgtaaaagacggagacagtgacttatccccagagctggctgttctgtgtggcgtaagccctcctgggcccatccggtcaactggagaatacatgtacatccgcttcacttcagacaccagcgtcgcggggacaggcttcaacgcctcctttcacaagagctgtggtggatatttgcatgcagatcgaggagttatcacatcccccaagtatccagacacctaccttcccaacctcaactgctcctggcatgttctggtccagactggtctgaccatcgccgtccattttgagcagcctttccagattcaaaacagagactctttttgcagtcagggggattacttggtgctaagaaacggaccagataaccattctccaccactgggaccttctggaagaaatggtcgtttctgcggaatgtacgcaccgtccactctgttcacctcaggcaatgaaatgtttgttcagttcatctcggacagtagtaatggtggacaagggtttaagatcagatatgaggcaaagagtttagcctgcgggggcactgtctacatccatgatgctgactctgacggatacctgacctcccccaactaccctgctaattatccccaacatgccgaatgcatttggatcttagaggcgcctccagggagaagcatacagctccaatttgaagatcaattcaatattgaagacacacccaactgttctgtgagctatcttgaattgcgtgacggagccaactcgaatgcacgtctggtttccaagttgtgtggccacactctgcctcatagctgggtatcctcgagagaacgaatatacttgaagtttcacactgacggtggttccagctacatgggattcaaggccaagtactctatagcttcctgtggaggaacagtctcaggggacagtggagtcatcgagagcattggctacccgacccttccgtatgcaaacaatgtgttttgtcagtggtttatccgaggcctcccaggacactacctcactctcagttttgaagattttaaccttcagagctctcctggttgtacaaaagactttgtggagatctgggaaaaccatacctctggaagagttctggggagatattgtggaaactccactcctagcagtgttgacacttccagcaatgttgcttccgtcaagtttgtcacagatggctctgtcactgcctcaggatttaggctgcagtttaagtccagcagacaagtgtgtggtggggatttacatggccctactggcacatttacttctcccaactacccaaacccaaatcctcatgcccggatctgtgagtggacgatcactgtacaagaaggaaggcggatcgtcctgacgtttaccaacttgaggctgagtacccagccatcttgtaacagtgagcacctcatcgtattcaatggcattagaagcaactcgcccctactacagaaactgtgcagccgtgtgaatgtgaccaatgaattcaaatcttcaggaaacaccatgaaagtggtatttttcactgatggctcccggccgtatggaggcttcactgcttcctacacctctactgaagatgcagtgtgtggtggatttcttccaagtgtctccggtggaaacttttcttctcctggctataatggaatccgtgattatgccagaaacctagactgtgaatggactctcagtaatccaaatcgggaaaattcatccataagtatctattttctagaactttccattgaaagtcatcaagactgtacatttgatgtccttgagtttcgagtaggggatgctgatgggcccctgatagagaagttctgtagcctgtcagcaccaacagcgcccttggtcatcccctaccctcaggtgtggatacacttcgtcagcaatgagcgtgtagaatatactggattctatatagagtactcctttacagattgtggtggaatacggacaggtgacaatggagtgatctcaagtcctaactatccaaacttgtacagtgcatggacccactgttcatggctgctgaaagccccagaagggcacaccatcactctcacattcagtgactttcttctcgaggctcatccaacttgcacttcagactccgtcactgtcaggaatggtgactccccaggatcgcccgtcataggacgatactgtggacagtcagtcccaaggccgatacagtctggttccaaccaacttatagtgacttttaacacaaacaatcaagggcaaactcgtggattttatgcaacatggaccacaaacgctttaggttgtgggggaacattccactcagctaatggtacaatcaaatctcctcactggcctcagacattcccagaaaacagcagatgctcctggacagtgatcactcacgaaagtaaacactgggagattagctttgacagcaatttccgaatccccagcagtgacagccagtgtcagaacagcttcgtgaaggtttgggaaggaaggttgatgatcaataagaccctgttagccacgagctgtggagatgtggctccaagtcccattgtcacatcagggaacattttcactgctgtcttccaatctgaggagatggcagcccagggcttctctgcatccttcattagccggtgcggacgcacattcaatacctcccctggtgacatcatctctccaaacttcccgaagcaatacgacaacaacatgaactgcacctacctcatagacgctgaccctcagtctctggtcatcctgacttttgtgtcctttcatttggaagatcgctcagctatcaccggaacctgtgatcatgatggcttgcacatcatcaaaggtcgtaacctctcttccactcctctcgtgaccatatgtggttctgaaactttgcgtcccctcactgtggacggcccagtgttgctcaacttctattctgatgcatacaccacagactttggcttcaagatttcctacagagccatcacctgtggtgggatctacaatgaatcctctggaatccttaggagcccttcctactcatacagcaactaccccaacaacctctactgtgtctacagcctccatgttagaagcagcagagtgataataattaggttcaatgatttcgatgtggctccttccaacctttgtgcacatgacttcctggaggtgtttgatggtcccagcattggaaatcgatctcttggaaagttctgtggttccacgcgtccacaaactgttaagagcaccaatagcagcctgaccctgctgttcaagacagattcttctcaaacagcaagaggttggaaaatatttttccgggagacaatagggccacagcagggatgtggtggatacctgaccgaggacaaccagagctttgtgtctcctgattctgattcgaatggacgctatgacaagggtctcagctgcatatggtacatagttgcacctgaaaacaaactggttaagctcaccttcaatgtgttcactctggagggaccatcgtcagctgggagctgcgtctatgattatgtgcagatagcagatggcgcaagcataaactcatatttaggtggaaaattctgtggctcccgtatgcctgccccatttatctcttccggcaacttccttacgtttcagtttgtctctgacgtaactgttgaaatgaggggatttaatgcaacatatacctttgtggacatgccttgcgggggaacatataacgcaacctcgacacctcaaaatgcgtcatcacctcatttatccaacatcggacggccatactccacctgtacttgggtcatcgcagctcccccacagcagcaggttcagataactgtgtgggacttacagctgccctcacaagactgctcacaaagctacttagaacttcaggattcagtacagactggtggaaaccgggtgactcagttctgcggtgcgaactatacaaccttgccagtgttctactcctcaatgagcactgcggttgtcgttttcaagtctggagttttaaacagaaactcgcaagtgcaattctcctatcagattgcagattgcaacagagaatacaaccaaacgtttggcaatctgaagagtcctgggtggcctcagaactatgacaataacctggactgcaccatcattctcagagccccgcagaaccacagcatttccctctttttctattggtttcagctggaagattcaagacaatgcatgaatgatttcttggaggtaagaaacggcggcagcagcacctcaccactgcttgacaagtactgtagcaacctgctgcccaacccggtcttctctcagagcaacgaactgtatctgcactttcacagcgaccactcagtcaccaacaatggctatgaaattatttggacctcctctgctgctggctgtggagggactcttttgggcgacgaagggatattcaccaaccctggctttcctgacagttacccgaacaacactcattgtgaatggaccattgttgctccttctggaaggcctgtctctgtcgggtttccctttctcagtatcgactcttctggtggctgtgaccagaactacctcatagtctttaatggtccagacgccaactccccaccctttggaccgttgtgtggcatcaacactgggatagcgcccttctatgcttcatcaaatcgggtctttataaggtttcatgctgagtatacgacacgtctttcagggtttgaaataatgtggagcagctga

SEQ ID NO: 1985 - DNA, 1607 bp, Rattus norvegicus
  Genbank Accession No. NM_053341
cctcgagcggcggcggcgcaggtctcccggccaagtccccacttctggctgctcatgccactgggactggggcgaaggaaaaaagcaccacctctggtggaaaatgaggaggcggagccaagccggagtgggctgggcgtcggggagcccgggcccctgggtggaagtggagcaggggaatcccagatgggtttgcccccacctcctgcttccctccggcctcgcctcgtgttccatacccagctggcccacggcagccccacgggccgcatcgagggcttcactaatgtcaaggagctgtacggcaagatcgctgaggccttccgactaccggctgctgaggtgatgttctgtaccctcaacacccataaagtggatatggacaagctgctggggggccagatcgggctggaggacttcatctttgcccatgtcaaggggcagcgcaaagaggtggaagtattcaagtctgaggatgctctggggctcaccatcaccgacaacggggccggctatgccttcattaagcgcatcaaggaaggcagtgtgattgaccacatccagctcatcagcgtgggtgacatgattgaagccatcaacgggcagagcctgctgggctgtcggcattatgaggttgccaggctcctcaaagagctgccccgaggccgcaccttcaccctcaaactcaccgaacctcggaaggcgtttgatatgatcagccagcgttcatcaggtggtcaccctggctcaggcccacaactgggcactggccgagggaccctccggctccgatcccggggccctgccacagtggaggatctgccgtcagcttttgaggaaaaggccattgaaaaggtggatgacttgctagagagctacatggggatcagagacacagagctggctgccacgatggtggagctggggaaagacaaaaggaacccagacgaactggcagaagctctggatgaacggctcggtgacttcgcattcccagatgaattcgtctttgatgtctggggagccatcggggatgccaaggttggccgctactaagactgggactgaacctggaccttgagataacctgctttgcccagctggggtttccagaaaccacagccaagacctgggctgacagcttaggctgtaactccgcagcctggggatggcacaggctgcaagtgccctgtggtccaggccccgctccaatcagtaccgccacggtgcccagcctggttggggtccccggccaacccctgccgggttccccacctacctcaatagagtaagcgcatggggagggaccaacacactaggcagccagccacctctatccccaacacttcccactatcagctggcaactgccccttctgtccccctggcctcagctctcttcggggtcatgacctccctactttactttttttgctttgtttttttcaagacaaagtcactatgtagctctggctgtcctggaactccttctgtaaaccaggctggccttgaactcacagagatccacctgcatctgcattcacagtgctgggaataaaggtgtgcatcaccactcccaaaaaaaaaaaaaaaaaaaaaaaaaaaaaa

SEQ ID NO: 1986 - DNA, 4474 bp, Rattus norvegicus
  Genbank Accession No. NM_053356
atgctcagctttgtggatacgcggactctgttgctgcttgcagtaacgtcgtgcctagcaacatgccaatctttacaaatgggatctgtacggaagggccccactggagacagaggaccgcgtggacaaaggggcccagcaggtccccgaggcagagatggtgttgatggtcccgttggccctcctggtccccctggtgcccctggcccccctggtccccctggcccccctggtcttactgggaactttgctgctcagtattctgacaaaggagtttcagctggccccggaccaatgggcttaatgggacccagaggccctcctggtgctgtcggagcccctggccctcaaggtttccaaggacctgctggtgagcctggtgagcccggacaaacgggtcctgcaggttcccgtgggccagctggccctcctggcaaggccggtgaagatggtcaccctggaaaacctggaagacctggcgagagaggagtcgttgggccacaaggtgctcgtggtttccctgggactcctggacttcctggcttcaaaggcattcgaggacacaacggtctggatggattgaaaggacagcctggtgcccagggtgtgaagggtgaacccggtgcccctggagagaatggaaccccaggtcaagcaggagcccgagggcttcctggtgagagagggcgtgtcggagctcctggtccagctggtgcccgtggcagtgatggcagtgttggccccgtcggccctgctggtcccattgggtctgctggtcctcctggtttcccaggtgctcctggtcccaagggtgaacttgggcctgttggtaaccctggccctgctggtcctgctggtccccgtggtgaagcgggtcttccgggtctttctggccccgttggacctcctggcaaccctggagcaaatggcctcactggtgccaagggagccactggactccctggtgttgctggggctcctggtctccccggtccccgtggtattcctggccccgttggtgctgctggtgccactggtcccagaggacttgttggtgaacctggtcctgctggctccaaaggagagactggtaacaagggtgagcctggctctgctggagcccaaggtcctcctggtcccagcggtgaagaaggaaagagagggtcccctggagagcctggatctgctggtcctgcagggcctccagggctgagaggcagccctggttctcgaggtcttcctggagctgatggcagagctggtgtgatgggccctcctggcaatcgtggttcaactggccctgctggagtccgaggtcctaatggagatgccggtcgccctggagaacctggtctcatgggacccagaggtcttcccgggtctcctggaaatgttggcccagctggtaaagaaggccctgtgggtctccctggcatcgatggcagacctggcccaattggcccagctggaccaagaggtgaagctggcaacatcggattccctggacccaaaggcccctctggtgatcctggcaaacctggtgagaaaggccatcccggtctcgctggtgctcggggagctccaggtcccgacggcaacaatggtgctcagggccctcctggacctcagggtgttcaaggtggcaaaggtgaacagggccctgctggtcctccaggcttccagggtctcccgggtccctctggtaccgctggagaagttggcaagccgggagaaaggggtcttcccggtgaattcggtctccctggtcctgctggtccaagaggagaacgtggtcccccaggtgagagtggagctgctggtccttctggtcctattggaatccgaggtccctctggagccccagggcctgatgggaacaagggtgaagctggtgcagtcggtgctccaggctctgctggtgcctctggtcctggtgggcttccaggagagaggggtgctgctggcatacctggaggcaaaggagaaaagggtgaaactggtctcagaggtgaaatcggcaaccctggtagagatggtgctcgaggtgctcctggtgctataggtgcccctggtcccgctggagcctcaggtgaccggggcgaagctggtgctgctggtccttctggccctgctggtcctcgaggtagccctggtgaacgtggtgaggttggtcctgctggccccaatggatttgctggtcctgctggttctgctggccaacctggtgctaaaggagaaaagggaaccaaagggcctaagggagaaaatggcatcgttggtccaaccggacctgtcggagctgctggcccatctggtcctaatggcccacctggccctgctggaagtcgtggtgatggagggccccctggtatgactggcttccctggtgctgctggacggactggtccccccggacccagtggtattactggcccccctggtccccctggtgctgctggtaaagaaggtattcgtggtccccgtggtgaccaaggtccagttggccgaactggagaaataggtgcatctggtccccctggatttgctggcgagaagggtccttctggagaacctggtaccacaggaccccctggcactgcaggtcctcagggtcttcttggtgctcccggtattctgggtctccctggctctcgaggtgaacgtggccagccaggtattgctggtgctctgggtgaacctggtcctctgggcattgcaggccctcctggggcccgtggtccccctggtgctgtgggcagtcctggagttaatggtgcccctggtgaagccggtcgtgatggtaaccctggcagtgatggtcccccaggtcgtgatggtcaacccggacacaagggagagcgtggttaccctggcaacattggtcccactggtgctgcaggtgctcctggtcctcatggttctgtgggtcctgctgggaaacatggaaaccgtggtgagcctggtcctgctggttctgttggtcccgttggtgctgtcggtccaagaggtcctagtggccctcaaggtattcgaggtgacaagggagagcctggtgacaaaggggccagaggtcttcctggcttaaaaggacacaatggattacagggtcttcctggtcttgctgggctgcatggtgaccaaggagctcctggtcccgtgggtcctgctggtcccaggggtcctgctggtccttctggccccattggcaaagatggtagatctggacatcctggaccagtcggtcctgctggcgttcgtggctctcagggtagccaaggtcccgctggtccccctggtccccctgggcctcctgggcctcctggtgtcagcggaggaggctatgactttggtttcgaaggaggcttctacagggctgaccagcctcgctcacagccttcactcagacccaaggactatgaagttgatgcaactctgaaatctctcaataaccaaatcgagacccttctcactcctgaaggctctagaaagaaccctgcccgcacatgccgtgacttaagactcagccacccagagtggaagagcgattactactggattgaccctaaccaaggatgcactatggatgccatcaaagtgtactgcgatttctctactggtgaaacctgcatccaggcccaacctgtcaacaccccagccaagaatgcatacagccgtgcccaggccaacaagcatgtctggttaggagagaccatcaatggtggcagccagtttgaatacaacgcagaaggggtgtcctccaaggaaatggcaactcagctcgccttcatgcgcctgctagccaaccgtgcttctcagaacatcacctaccactgcaagaacagcattgcgtacctggacgaggagacaggccgcctgaataaggctgtcattctgcagggctccaacgacgtcgaacttgttgctgagggcaacagcagattcacctacactgtccttgtcgatggctgctccaaaaagacaaatgaatgggacaagacagtcattgaatacaaaacgaataagccatctcgcctgccattccttgacattgcacctctggacatcggtggtactaaccaagaattccgtgtggaggttggccctgtctgtttcaaataagtgaactcaacctaaattaaaaaacaaaaacccctgaaaaaaactttctctttgccatttcttcctttaaaaaaaaaaaaaaaactgaaagctgaatccttccgtgttttctatgcacctacatcttaaactgtgggcaaaagagaaggattggtcagagcagtgtgcaatatgatccagataagtcccctccctcaggccctccccaaaacgtttgcagtgttatttctgtgggtttttttttaaacactctgacacctgttgtggacattgtcaacctctgtaagaaaacccaaataaaattttaaaaataaaataaaaagaaacccatgaacatttgcaccaaaaaaaaaaa

SEQ ID NO: 1987 - DNA, 626 bp, Rattus norvegicus
  Genbank Accession No. NM_053374
catcatgaccatgagacactgtggctgtgcagcagaccccagtccttggtgggtcctgcttctatatgtccatgttgtcattctggccagagccacatctgcacctctgacaactgccactgtcttaaccagaagctcaaaggacccgtgctcttcctggtctccagcagtcccaactaagcagtacccaacattggatgtgatctggccagagaaagaagtgccactgaatggaacgctgaccttgtcctgcactgcctgcagccgcttccccaacttcagcatcctctactggctgggcaatggctccttcattgagcacctcccaggccggctgagggagggccacacaagccgggagcagaggaacgcaagcacctggctacacagggccttggtgctggaggaactgagcccctccctactaagtaccaacttctcctgtctgtttgtggatcccggacaggtggcccagtatcatgtcattctggcccagctctgggatggattgaagacagccccatccccttctcaagaaaccctctccagccacagcccaggacccagatcagcaggcccaggggccccatgaagccaaccacagcatgaccttgaccagagcctgg

SEQ ID NO: 1988 - DNA, 3950 bp, Rattus norvegicus
  Genbank Accession No. NM_053380
ctgcggagggagcgctgaccatggctccttggcccgagttggaaaatgcccaccccaaccccaataaattcatcgaaggggcctcaggtccacagtctagcataccagacaaagacaaggggaccagcaaaacaaatgacagcgggactcctgtagccaagattgaacttctaccctcatattccgccctggttctcatagaggagccccctgaggggaacgacccctgggacctgcctgaactccaagacaatgggatcaaatggtcagagagagactccaaagggaagattctctgcattttccaggggattgggaaattcatccttctcctggggtttctctacttgtttgtgtgctccctggatgtactcagtagtgccttccagcttgttggaggaaaaatggccggccagttcttcagcaacaactccattatgtctaatcctgtggctggacttgtgataggggtgctggtgacagtcatggtgcaaagctccagcacgtcctcgtcaatcatcgtcagcatggttgcctcctccttgctgtcagtccgcgctgccatccccatcatcatgggtgctaacatcgggacctccatcaccaacacgattgtggcacttatgcaggcaggagacagaaatgagttcagaagggcatttgcaggagctactgtccatgacttcttcaactggctctctgtgttggtgctcttacctctggaggctgccacccattacctggagaaactgaccaaccttgtgttggaaaccttcagcttccagaatggagaagatgccccagacattctgaaagtcataacagaccccttcacaaagctcatcatccagctggataaaaaagtcatccaacaaattgcaatgggtgactcagaagcccagaacaagagcctgatcaagatctggtgtaaaactataagcaatgtgattgaggagaatgtcactgtcccctcgcctgataactgcacctctccttcatattgctggactgatggcatacagacctggaccatccagaatgtgactgagaaggagaacattgctaaatgccagcacatcttcgtgaatttcagcctcccagacctcgctgtgggcatcatcctgctcactgtctccctgctgatcctttgcggctgtctgatcatgattgtcaaactgttgggttctgtgctcaggggacaggttgccactgtcatcaagaagacccttaatactgatttcccctttccctttgcctggctgactggctacctggccatccttgtgggggcaggcatgaccttcatagtgcaaagcagctctgtgttcacttctgccatgacgccactcatcggtattggggtgatcagcatcgagagggcatatccactcacgctgggctccaacattggcaccaccacgactgccattctggctgccttggccagcccaggcaacacattgaggagttccctccagattgccctgtgccattttttcttcaacatctctggaatattgctgtggtacccaatcccattcacccgtctgcccatccgtctggctaaaggcctgggcaacatctctgccaagtatcgctggttcgcagtcttctatctcatcttcttcttcctcctgaccccgctgacagtgtttggcctgtccctggctggctggccagtgctggtgggcgtgggtgtgcccatcattctgctgatcctcctggtcctgtgcctccggatgctgcaggcccgctgccctcgcatcctgcccctgaagctccgggactggaatttcctacccttgtggatgcactctctgaaaccctgggacaacatcatctccctggccacctcctgcttccagaggcgctgttgctgctgttgccgtgtgtgctgccgtgtctgctgcatggtgtgtggctgcaagtgctgccgctgcagcaagtgctgcaagaacctggaggaggaggaaaaggagcaggacgtcccagtcaaggcttctgggggctttgacaatacagctatgagcaaagaatgccaagatgagggcaagggccaagtggaagttctgggcatgaaggccctgtccaacactacagtgttctaggagcacctagtagtcaggggtgcctccctcccataagacagaacagagatgtagactgtgaacatggcccacagatgaccacatccacccatggcctataatgccttcaaagtccatcctcacccaaagacattaagagggaggcattagggaaggttctggaaagatccaatgtaaagagtatttgtaaatatatgtacaaagcagttgtttcttggtataaaacctcagccacatctctcattttataagtccactccttacccaataacttctcctactcacccctgccccagagcagccaagttcaaacacactgaatgtttgtagcccataggtgtgagcctttctagctcacactggcagggcatgttctattaaggcatcgtctggtatagtcaggccaagcagctgaccacagtgtcctctgaagtccgcggtgctcagcttcctaggatggagtgaatgggggttcacgacgtgtttggcacattgttggtttttctatgcctagggctgggactagaataggagacattgttgctacatatttctgatggacttgtaagacctgtgtcccagccctcctctccattgctactgcctgggtcatctgctggtgaagggtctgcctatctttctcttttgtgcaaggagactttccgggccagcttttcatgctctgtttcatccaccccctcaccctcctgctcatgtattcatatcaaacccatcgtcttacacagatgagcttcctaccccttccatgcctacaaagttccaagggattgcttaggagggaggagatgggaaatggctaaaatgcccttagaatcaagatgaagccagtaagtagggttgggagtgtgcatgtgggagcttgtatggcacaggatgcaatagtcaatacgctgtgctcatgtgcagtccccatggtggctctgcaagcattcccatcccatccccttccccacaagaacgggcctcagcttgacttgggtcaggctgtgtggttccacggccatcctcttccatcatactgccatgggaagaggctgagggccagcccgagcccctctgtagataaacgttcccccaagagccatttatgcggcataatttatagccatgcatctgtacagaatacttcataacttatagtaaatagtgacttgttttatagtgtctcatttggaaatgaggcagggttcttttatgtactgtgaacagaaagaacacctttgtatattttgtaatactgcctttaaacacaactctcgagggtcatgctacacctccccctgtaaatatgtaaggtacaccccaggaaggtgctttgccctctgttgattactttttttaaaaaaaatgggatctttgtttctgtgttaattgtatttttttaaaacgggttgagggaagggagaaatacgcacccccgcccccaagtactgcttccaattgcagggtgctgtaaacaagagaggtgtatttccttactcaaacctcaccatacaccaccatgggaagctgtagtttttggggttcccagtgacactgggacacagagaggacttagtcccaccttcactcagccttctctttccctggtcttgtggactagctactgagagctatgctaagtaaagcatagcattttgtggttaatgaatcttaccgggtttggaagctgatttttgaagctgtatgcaggttatcttttcagtcttgttttaaaaatcaattccacctgtaagagagaaggggaggggggcagtgagtgggatgtaaagtgaaaaagaaaaataaaaaatattaattccaatatggtaaaaaaaaaaa

SEQ ID NO: 1989 - DNA, 892 bp, Rattus norvegicus
  Genbank Accession No. NM_053395
ggaccggagagggacagagcactccagctattccagccacatgaaaagcactggaattgagatctcagctcagaggacaccgggagttccttctaccctgtaaagcgttttctgtttttgcacctggctgcctaggactgtcctcaggcagtaaacaaatccagagagcaggtataagacctcttgaacatgtcgaagcagccaatttccaacgtcagatccattcaggccaatattaatattccaatgggagcctttcgtccgggagctgggcagcctcccagaaggaaagagagtacccctggaactgcggagggagcacctgctactcccgaggaaaagaagccagttcctggaatgaagaaattcccaggacccgtcgtcaacctgtctgagatccaaaacgttaaaagtgaactaaaatacgtccccaaaggtgaacagtagttcaaaggggtcagaaggcttgacgtgctttctcaatggaaaaaacaatgggttgaaataaacaacttcatgagaattttatatatttgtatgatgatcacaaacttcctgaatgcccaagactctagcaaaaaatatcctgtttgtacatttatatttcttccttctacttggctgcatttctcactttagctacatttttggcaccttgcagagcaaatgagcacatgaatttaccacctggggagtgtggttttgaggagagatgtgatttttatggaggggggtacagcaatgtgcatgcagtgattttgatattaagtacttttaagttacttcccacagtcttttggtcaatatttgaaatgtcttcttcaccttttaaatgatctcaattaactttttatgagttgaaataaatatttgagtaaatgtaaaaaaaaaa

SEQ ID NO: 1990 - DNA, 2037 bp, Rattus norvegicus
  Genbank Accession No. NM_053433
ctctttcagactttcgagaagactaggggtttagacacagagaagaaaggaagacaaataaaaggccaccatgaagaggaaagtggcagtcattggggctggtgtcagtggtctggctgccatcaggagctgtctggaggagggactggagcccacgtgctttgagaggagtgatgacgttgggggcctgtggaaattttcagaccacacagaagagggcagggccagcatttaccaatcggtcttcaccaactcttccaaagaaatgatgtgttttccagacttcccctatcccgatgactttcctaacttcatgcataacagcaagctccaagaatatatcacttcatttgccacagaaaagaaccttctaaaatacatacagtttgagacacttgtaaccagaatcaataaatgtcctgatttctcaaccactggcaaatgggaagttaccactgaaaagaacagtaaaaaggaaacagctgtctttgatgctgtaatgatttgttctgggcaccatgtatatccccatctaccaaaagactcctttccaggtctgaaccgtttcaaaggcaaatgcttccacagcagggactataaggagccaggaacatggaaaggaaaacgagtcctggtgattggcctggggaactcaggttgtgacatcgctgcggaactcagtcacgtggctcagcaggtcatcataagctccagaagtggttcttgggtgatgagccgggtctggaatgatggctacccttgggacatggtggtgatcacacgatttcaaacatttctcaagaacaacttacccacagccatttctgactggtggtatatgaagcagatgaacgcaagattcaagcatgaaaactacgggttgatgcctttaaatggaacactcaggaaggagcctgtgttcaatgatgagcttccagcccgcatcctgtgtggcactgtgtccatcaagcctaatgtgaaggagttcacagagacctccgctgtgtttgaggatgggactgtgtttgagggcattgactgtgtcatcttcgccacaggctatggttatgcctaccccttcctggatgacagcatcatcaaaagcagaaacaatgaggtcaccttgtacaaaggcatcttccctcctcaactagagaaaccaaccatggcagtgattggccttgtccagtccctgggtgctgccatccccacaaccgacctgcaggcacgctgggcagcacaagtaataagaggaacttgcattttgccttctgtaaacgacatgatggatgatattgatgagaaaatggggaagaagcttaaatggtttggcaacagcaccaccattcagacagattacattgtttatatggatgaattggcctccttcatcggagcaaagcccaatatcctatggctgtttctcaaggaccccaggttggccatagaagtgttctttggcccttgcagcccctaccagttccggctggtaggcccagggaagtggtcaggagccaggaacgccatcctaacccagtgggaccggtcactgaagcctatgaagacccgtgtcgtcggtggtattcagaaaccttgcttgtattcccattttctcaggctcctggctgttccagtgctcattgctttgttcctcgtgttgatctgattgagattccctctagaatgtctgcgagtcaccgacaataaccagacaagaactttgctatttaaaattaaggttttcatacctctccctttcctgttcaagatcatttgccagaactctagacatttattagtaagcaagacaatgttttgctctggccttgtaaataagtcacctttcagaatcatgctgacccgcagtgagcataagtcatttctcctaagttccactaacaatttgtaacaagaatggtatttttatggacaacttgaatcatctcctgaaagggttgaacagattccatttctcttttaaacgatgcttaaaagatatacttcagatctggacagggaataaagtacagcatttag

SEQ ID NO: 1991 - DNA, 3258 bp, Rattus norvegicus
  Genbank Accession No. NM_053438
cgacggccgtggcctgcagaggcggcagggacggtggccgcggttggcgcgcgcatccgcacggggctagtccccgcgcagctacgcaactgacaggaagcctccctggagagccgcgtcggggcctagtgttatttgctttttgctttttctcccccttcacgactgtggtctcgcgctcttccgcagcgggagccgccgcgacgccccctcgcgggccgccggcctgagaggcgccgcccgcgggaacctggagccgccgccgggcctgggcggccgccggggcctgaagcctgggcgttcggcgcggcgctgcgacgaccgctccaacccgcgctgggcgcgccgggccccaggcctggcccagccgagcaccgcgccttccggactggggccacgtagtccggcgccaaccgccctccgctggcccgcagtctatcggagctgcctcctggtcacccctggtgggctcttgccctcttccagccttccgcagttcgatgggtggagtgcttttgaacgtgccctcttctccctttctcagctcttgaccgcaaggccagagccggggccctcagccgcacgcacgcagcgatccacctgcctccccgcggggatggcccgcgggtgccgccaccgccgcgcgccctcgctgccctcgccgccctcgccaggctacgctcgtcgccccgcactcgaccccctcttcttgtccacggcgtcccggctcccggcgacgccaagagggcgaagatgtggctgaagctgtttttcttgctcctgtatttcctggtcctgttcgtcctggccaggttttttgaggccattgtgtggtacgagactggcatctttgctactcagctggtggatccggtggcattgagcttcaagaagctgaagaccattctggagtgtcgagggctgggctactccggactacctgagaagaaagatgtacgggagctggtggagaagtcaggtgacttgatggaaggtgaactctattctgctctcaaggaagaagaagcatctgagtctgtttctagtaccaatttcagtggtgaaatgcatttctatgagcttgtagaagacacaaaagatggcatctggctggttcaggtcatagcaaatgacagaagtcctttggtgggtaaaatccactgggagaaaatggtaaaaaaagtgtcaagatttggaatacggacaggcactttcaactgttccagtgatcccaggtactgcagaaggagaggctgggtacgttccactctcatcatgtctgtcccacaaacaagcacatctaaagggaaagtcatgcttaaagagtacagtgggcgcaagattgaagtagaacacatttttaaatggataactgcccatgcagcttctcggatcaaaactatatataatgttgagcatttgaaagaagaatggaataaaagtgatcagtactgggtaaaaatatacctgtttgcaaaccttgaccaaccaccagctttcttctctgcattaagtataaaatttactggaagagttgagtttatttttgttaatgtggaaaattggaacaacaagagttatatgacagatattggtatttataacatgccgtcatacatacttagaactcctgaaggaatttacagatatggaaatcacacaggtgaatttatatcccttcaggccatggattcatttttacgctcattacaacctgaagtaaatgatctgtttgttttgagtttggttctagttaatcttatggcttggatggacttatttattacacaaggagcaaccatcaagcgatttgtggttctcataagcactttagggacatacaattccctattaattatttcttggctacctgtgttgggctttctacagctcccttacttagatagcttttatgaatatagtttaagattgctgcgatactctaatacaaccacactggcttcgtgggtaagggcagactggatgttttactcttcacacccagccctgtttctcagtacataccttggacatggtttgctaattgattactttgagaagaagagacggcgcagcaacaatgatgaagttaatgcgaataatttagagtggttatcaagtctgtgggactggtacaccagctacctcttccacccgattgcttcttttcagaactttcctgtagactctgattgggatgaagaccctgacttattcttggagcggttagctttccctgacctttggcttcaccctctgataccaactgattatattaaaaacttaccaatgtggcggtttaaatgtcttggggctcagtctgaagaagaaatgtcggagagttctcaagacactgaaaatgactcagatagtgacaacacggacacttttagtagtagtaaggatgtatttgaagataaacaaaatgttcacagttctccaggaagaacaagtcgctgcgatactgaggcttgttcatgtgccaataaatgtgtcagcagcccatgtgaaaggaagaggaggtcatatggctcacataatactaaggaagatatggagccggactggctaacttggcctgctggtacgctgcactgtactgaatgtgttgtttgccttgagaattttgagaatggatgtttgctgatggggttgccttgtggtcatgtgtttcaccagaattgcattgttatgtggttggctgggggccgacactgttgccctgtttgccgttggccttcatataagaaaaagcagccatatgcacagcaacagccgttgtcaaatgatgctccatcttgaccatgtgcaagttgtccaataagctttgagtatcttacagcttgcctttttaatgttagtcacaatgtttttgtggtttgaagtttagtttaatgttagtgcagtgacaggaaatacacattatgctgatgttgatgacagaatttatttggatgccttgtgtgtcaattgaatgcatactaaactgtaaaaaaattatttacagcattgaaaattcagaagttaatggttttttgtaagcacaaaagaagtatggtagaaatttatcttagcaagactttatgaggcaggatcaaatcctagtgggcctgagctgatttcttaccctaaatgttttttccctttttacaatctctgtccagcacctcttggttaaataatgtatgctctgagacatgaaattaaaacagatctataaaataaattattttaaaagcaaaaaaaaaaaaaaaaaaa

SEQ ID NO: 1992 - DNA, 1084 bp, Rattus norvegicus
  Genbank Accession No. NM_053439
catctttccagcttcagtcggacaggcgcggagactcttctggaagccgctctctcccgcaggatcgccgcgatggccgcccagggagagccgcaggtccagttcaagctcgtcctggtgggcgacggcggcaccgggaagacgacgttcgtgaagcgccacttgacgggcgagtttgagaagaagtatgtagccaccctgggcgtggaggtgcacccgctcgtcttccataccaacagaggacccatcaagttcaacgtgtgggacacagccggccaggagaagttcgggggcctgcgcgatggctactacatccaagcccagtgtgccattataatgtttgacgtaacatcaagagttacttacaagaacgtacctaactggcatagagatctggtacgcgtgtgtgaaaacatccccattgtattgtgtggcaacaaagtggatattaaagacaggaaagtgaaggcaaaatctattgtctttcaccgaaagaagaatcttcagtactatgacatttctgccaaaagtaactacaactttgaaaagcctttcctctggcttgccagaaagctcattggagatcctaacttggagttcgttgccatgcctgctcttgccccacctgaggtggtcatggacccagctttggcagcacagtacgagcatgatttagaggttgctcagacgactgcgctcccggatgaggatgacgacctgtgagaaaatgaagctggagccctgcgtcagaagtctagttttataggcaactgtcctgtgatgtcagcggtgcagcgcgtgtgccaccttatttagctaagcagatcgtgtacttcattgggatgctgaaagatgaatgggcttcgagtgaatgtggcagttaaacatacccgtcattttttggacttgcatatttagctgtttggaacagagttgtttccttcctgaatttcaaagataagactgctgcagtcgcatcacaatattcagtggtgaaatcttgtttgttactgtcattcccattcttttcgtttagaatcagaataaagttgtatttcaaataatctaaaaaaaaaaaaaaaaa

SEQ ID NO: 1993 - DNA, 1654 bp, Rattus norvegicus
  Genbank Accession No. NM_053440
tctagcacggtcccactctgcagactcagtgccttactcagactcctctctcgctctctccgcggctacagctggacccttctccttcgcctttgccaccgctccgagcgtgcacatccctacaatggctaaaacagcaatggcctacaaggaaaaaatgaaggagctgtctatgctgtcactgatctgctcctgcttctacccggagcctcgcaacatcaacatctacacctacgatgacatggaggtgaagcagatcaacaagcgtgcttccggccaggctttcgagctgatcttaaagcccccgtctcccatctcggaagctccacgaactctagcttctccaaagaagaaagacctgtctctggaggagatccagaaaaagctggaggctgcagaggggcgaaggaagtctcaggaggcccaggtgctgaagcagttggcagagaagagggagcacgagcgagaagtcctccagaaggctttggaggagaataacaacttcagcaagatggcggaggagaagctgatcctgaaaatggaacaaattaaggaaaaccgtgaggctaatctagctgctatcattgaacgtctgcaggaaaaggagaggcatgctgccgaggtgcgcaggaacaaggaactgcaggttgaactgtctggctgaagcaatggcgggtatggcacgcccctcccatagtaaatccccctgcctatattataatggatcatgcgatatcagtatgggaaaatgtatgacatggtttaaaaagaactcattatgaaaaaaaaacagaatcaaaaataaaataaatcaatgcggtctctttgcagaatgttttgcttgatgtttaaaaaagtaccttggatcttattttgtaaatatttacatttttgttaaaaaatacaagtattgcattatgcaagttatttcataatcttacatgtcctgtaacaggcattcgatgttgtgtcttcccactcaaatgaatttgctagctctattcttttggaagctcccccatgttgaactcagtccctgcccttttcattccacccaaaaatgaggtcagtagacagtctatggtgctagaaacccaccattgcctagtgacctagatgactccatactctccgagcttggccaagaccacacctagatcgtggggaccgtgtgcccatgtgaacctccacatttctctgctcataatctgcttcctgcctagaaaccacaaagccaggctaaggaaatccaccagtcctagcactgacctctgcttctcgtggagtgtgtgcttcactcgtgtttgggttttagaaagagatgaatgggaagacagagctgtgctcaatgagggtagaagggcgaggctgaaccttctaatgggccgaacacaaacacaaagctagagggttcgagcggccatgacgttgttcttcatgaagtgggctttcttctcttatttcggttattttgatggaatgacttaatcaacatgtcgatggcttatctgtgggtgccatgggtgacgatgttcgttttaagcttttgcctgtagtacaagcacatgatgctactaaatatttttccacttggagactgtgagctggttgttgcattaaacacacaaacgaaatcacaaacaaaaaaaaaaaa

SEQ ID NO: 1994 - DNA, 4117 bp, Rattus norvegicus
  Genbank Accession No. NM_053442
gccaccctgccctcacagatggaacgatctgcggcgtgagcacggagctcggagcggacaagggcgagaaggggcgaccgcagcaggtggaaacctgatcgcgagccggcgagcgagaagaaagtacctgagcaccgctcctcctccgccctctcggctaacgagaactacttttaccctcgtggtaaaagagacttaagggaaggtggaggcgatctgtttcgttaggagggctgcagggaaattctgaccagagcaagccgccgcccggtacaccgagcagagccatcctgggcttctgaagataaacgctttccggagaattccagctggagtcgctggtacagttctatttttgtatttagatatatatgttctttgccttccatttaaaaagcacggcccttgtttgttagcagtgacacgtgtgactctcgtttgctgtcacttttagagcctaggagcgctcgctctccgtttctgaaaagggcgttctaattggaaacttgtttttccgcgtatctctgcatttatacgcacgagcgtttagaaagagactgctctttttagcttttggtggtcggaaccctacggagaaagatggaaaagggaacccgacagcgaaacaacaccgcgaagaaccacccggaccgcggatctgacaccagccctgaggccgaggctagctcgggagggggcggagtagccctgaagaaagagatcggattggtcagcgcctgtggtatcattgtagggaacatcattggctccggaatcttcgtctcaccaaagggtgtgctggagaacgctggctcggtgggccttgctctcattgtctggatcgtgacgggtgtcatcacggctgtgggagctctctgctatgctgaactaggtgtcaccatccctaaatctggaggtgattactcctatgtcaaggacatcttcggaggactggctgggttcctgcggctatggattgctgtgctggtgatctaccccaccaaccaagctgtcatcgccctcaccttctccaactatgtgctgcagccactcttccctacctgcttcccccctgagtccggcctgcgactcctggctgccatctgcctgttgctgctcacatgggtcaactgctccagtgtccgatgggccacccgggttcaagatatcttcacggctgggaagctcctggccctggctctgatcatcatcatgggtgttgtgcagatatgcaaaggagaattcttttggctggagccaaagaatgcatttgagaatttccaagaaccagacatcggcctcgtcgctctggctttcctccagggctcctttgcctacggaggctggaacttccttaattacgtgacggaggaacttgtggatccttacaagaaccttcctagagccatcttcatttccatcccactggtcacatttgtgtacgtctttgctaatatcgcctatgtcactgcaatgtccccccaggagctgctggcctcaaatgcagtcgctgtgacttttggagagaagctcctaggggtcatggcctggatcatgcccatttccgtcgccctgtccacatttggtggagtcaacggttccctcttcacctcctcccggctgttctttgctggagccagagaaggccaccttcccagcgtgttagccatgatccacgtgaagcgctgcaccccaatcccagcactgctcttcacatgcctctccaccctgctgatgctggtcaccagtgacatgtatacactcatcaactacgtgggcttcatcaactacctcttctacggggttacagttgcaggacagatagtccttcgctggaagaagcctgacatcccccgccccatcaagatcagcctgctgtttcccatcatctacttgctgttctgggccttcctgctgattttcagcctgtggtcagagccagtagtatgcggcattggccttgccatcatgctgacgggtgttcctgtatacttcctgggtgtctactggcaacacaaacccaagtgtttcaatgacttcattgagtccctaactctagtgagtcagaagatgtgtgtggtcgtgtatccccaggagggggactcggggaccgaggaaacaattgatgacgtagaggaacaacacaagcctatcttccagcctactcctgtcaaggacccagactcggaggagcagccctgaagactgccagcctttaactggccacccccccttcatcctttctgccctgtatccctgcctaggtccccccaacacacacacacacacacacacacacacactcacacacacacacacacacacacacacacacacacacacacacttctgttaggcaggggcaagacctgggtgtccacagcgagacattctaaacaaagaccctgacctttgtacccaaagaacctgcttccagcaccaaggcccatggtcaaggtcagtgcaccgggacctgcacacaccctaaggtttagaggagagtggaggtgccattggtaccctacagggcctttcctcctgggcccatgctctttaggtgcctctaagaaacctgggttcactactgtttcttctccctaaccctgagcccaggcaaagcctccactggaaaaaaggtagcatccccagtgagttagttggggaagacaactcaaattgtcaccattaacagtcagctggggagactcagatgtggcttcattcaccagggagccaaaaggcagagggctcacttctctttgccttctgcactctgtactaccacggctccactgcccagcctcgacctgagacccacaaagttccctttcaggatgcctcttccccacagagctaaggaccaagaaggaggactgcccccctcccccccagctctcagccaggcttgtggaatatatagggaaaggctcagactgcagaagccaagccctgccccacccctgcccctgcctcctgtcctcttgtggtgccaaagctccctgaagcagaaaaacttcttatattcagtctaacagacctatctctcttaagggcaaagcgactcagctcctccctgtccccctgtgtgaaagaaagagcagtagccctcttctcccagcagctctgcccactcacagatctgcctgccgtcctcctctttcctcccctggaccttggctcaaggaccaggtatgaaggatcccccaagtccttcaggcctgaagtaagagtcaacccagccttaagtcatctcccatccaagaactgggtctaaaacgttccccatttctaaccttcaagacagacctgatgttaaatccttccctggaaggaagggtgctttcccccttcccaggggtgctcatccctcaccctggggagaccatgttggtgaggtagggggagaatgttttctgaaggccagttcctctcccctcctccagctcaaaacaatctcaccgtcctcctgccatcccatttgggacaagatgacaggatggcactcactttggagacctcagaaaagccccttccaggagagctgctggtctgtgctgtacaggaagggtgacagcatctgccttctcctggcagcctccacacctgctgtgcttaggacaggatcctttgatcacaaagcagaaccctaatcctgttccatctactcaaactggaacacccaggggccttttcctggtctcccaacttcccacctagctcaccctacccctaactggtgagaggctgagtttgggctgaattgtggcccttcagaatacagtccaggcaggctgtggggcctctgggggggccagggaccacccctctacccctttcctcccattccttcagcctgcacctgcccctccttgaattattgtctctctctctctttttttttttaagtggatgccttactttttggataactatttttgaagctggtatttctatttcttttggattttttaatgtatggtggtttgggggcagagctagaaccttaatcgtctgtcgctgagttcatttaggttttaaattttattggtttgttttatggagtattttcttttctcgtaataaaattttaaatggaaatgaaaaaaaaaaaaaaaaa

SEQ ID NO: 1995 - DNA, 1629 bp, Rattus norvegicus
  Genbank Accession No. NM_053453
cgggtgtctgagaatgcaaagtgccatgttcctggctgtccagcacgactgcgtacccatggacaagagcgcaggcaacggccccaaggtcgaggagaagcgggagaaaatgaagcggacactcttaaaagattggaagacccgtttgagctatttcttgcaaaactcctctactcctgggaagcccaaaactggcaagaaaagcaaacagcaaacttttatcaagccttctcctgaggaagcgctgctctgggcagaagcatttgatgaactgctggccagcaaatatgggcttgctgcattcagagcgtttttaaagtccgagttctgtgaagaaaatattgaattctggttggcttgcgaagacttcaagaaaaccaaatcaccacagaaactgtcctcaaaagcaaggaaaatatacaccgacttcatcgagaaggaagctcccaaagagataaacatagactttcaaacaaaaactctgattgcccaaaatatccaagaggctacaagtggctgcttcaccacagcgcagaagagggtgtacagcctgatggagaacaactcttatcctcgtttcttggaatcagaattttatcaggacttgtgtaaaaagccacagatcaccacggagccccatgctacatgagacagggagacccccaccgaggacattccattctgtctcccgagagcaaaggctgtaacctgccagaaaaaaaaaacaaactgaccttgaattcagcctgagtgttaggaaaacatcgctcagaactattgattcaatgttgggtagtgaatcaggaagccagcaacctaggagagtctctgtgagaagtttcccttgctgtgtgaagagcagagggagggaacagggttctgaatgggttcgtccctgtcaggaaagcagggtgtgagatgaaagatacaatggaatgttgttggagcatttaaaatcaataggtctgggattatgtggccttagctagctggctgtacacctttccctgaactagtccatgttaccacgtagtggttttagttctagttttaatattttagtactaagtaacattataatgtttactgtgtgcaagggtgttgactgacgttcttaggactacagatcattaatactattgtgtcatgtatcactgaaactgaaaaagcgtgtttgcattgttaaatggtgtgtgtgatagagtgaatgctgtgccgtgctgtagaaccagtgtccgttccgagtgccaaaaactgtcttgcgggcagctaaactctgaagtggtttttgaatacttttgaataaatttattttgctaaataatgtcattgaacatttggaagtccagatgtggttctgttgttcgatttcagtaactggaaacatgtcagatataagagagaatgactttctagtaaagaggtatcagtgtgggttaattgttgtgcctgtccactgagaaatcgacagccctgagaagtgaagaatgattgcttccaggaagatgttctctttaatcctatagacatgatgtagtcttaagaaaatcagatcacattcctaggaccactcattgtgaaagtcaaatgtgttatttaataaaaaaaaaaaaaaaaaaaaaaaaaaaa

SEQ ID NO: 1996 - DNA, 2303 bp, Rattus norvegicus
  Genbank Accession No. NM_053463
cgatgcctacctctgtgccccgcggggcgcctttccttctcctaccacctttactgatgctgtctgctgtgctggcagtgcctgtggaccgcgcagcacctcatcaggaggacaaccaggccactgagaccccggacacaggcctgtactaccatcggtacctccaggaggtcatcaacgtgctagagacagatgggcacttccgggagaagctgcaagctgccaacgctgaggacattaagagtggaaagctgagtcaagagctggacttcgtcagccacaacgtccgcaccaagctggatgagctcaagcgacaggaggtatcaaggcttcggatgctgctcaaggccaagatggatgcaaagcaggagcctaacttgcaggtggaccacatgaaccttctgaagcagtttgaacacctggaccctcagaaccagcacacgtttgaggctcgggacctagagctgctgatccagacggccacccgagacctcgcccagtatgacgctgcacaccatgaagagttcaaacgctacgagatgctcaaggaacatgagcgaagacgttacctggagtctctgggagaggagcagcggaaggaggctgagaggaagctacaagagcagcagcgcagacaccgggaacaccccaaagtcaatgttcctggcagccaagcccagttgaaggaggtgtgggaggagctagatggattggaccccaacaggttcaaccccaagaccttcttcatactgcatgacatcaacagcgatggtgtcctagatgagcaagaactggaagctctgtttaccaaggagctggagaaggtgtacgacccgaagaacgaggaggacgacatgagggagatggaggaggagcggctgcgcatgcgggagcatgtgatgaagaacgtggacaccaaccaggaccgacttgtgaccctggaggaattcctggcatccacacagaggaaggagtttggggaaactgcggagggatggaagacagtggaaatgtatccagcctacacagaggaagagctgaagcgttttgaagaggagcttgctgcccgggaggctgagctaaatgccagagcccagcgcctcagccaggagacagaggccctggggcgctcccaggaccgcctagaggctcagaagagagagctgcagcaggccgttctgcagatggagcaaaggaagcagcaacagcaagagcagagcgctccgccttcccaacctgatgggcagctgcagttccgtgcagacacaggggatgctcctgtcccagctccagcaggtgaccagaaagacgtgcctgcttctgaaaagaaggttccagagcagccccctgtgctgccacagctggattctcagcatttataagccctcagagatcccggccctcaagttcccacagacagtgatggaagctggatgaagtgtccttgcagcctttctggagaccaaagccttcatggcctccaggggagaacagggccaccctgttcctcagatgcgcttctgcccatgtctaccagtctgttctcacagcctctgggtcccagtcctgccttcctccctcccttccttggcagggactcaactgcaggagcccctcaccccacctgagtgcacaccccaggcctgcctgccttccatgctttgctcttacctgtcccaggctcaacctttctgcttcctgtacctgtcagtgggtcacaggagcttgacttggtctctccaactctttgccttgtgagaggccaatgatctcaattccttttggtggctagaggccgccacaatgtggggtgtcctatcagctctgcctgggactcctgaactccaccaccaccccaccagccttaccctaaccacctgggcccaatacctacctgagggtcccagaaggggcccagatatggctacaccccttactgaggtccagcctcactcagccccctatgggggctcctgaaaattggttcacccacttccctggcttcaggccacactgctgtgtcctgctctgtgtcccagtctcatccaactatagcctggcacaaataaacattagcatatctgtgtgaatgtactgccctcttgcaagtccccctgcatgccacctgctcgactccctggtgtcctgtggcacatacttccactgccaggaggcttgccgggggctttctgtgtgctcttgccagaatggcctccttgcttcatttttgccatggaaacagaaaacccaaacctgagcttgaaaaaaaattaatatcttaaataattaaaatatatatatgt

SEQ ID NO: 1997 - DNA, 704 bp, Rattus norvegicus
  Genbank Accession No. NM_053472
ccgccgtcttcagcttgcaactatgttttccagagctacccggagtctggtaatgaagacaggaggactcagaactcaagggacacacagcccaggaagtgctgctagcagcagccagcggaggatgaccccctatgttgactgctatgctcagcgctcctatcccatgccggatgagccttactgcacagagctcagcgaggagcagcgggccctgaaggagaaagagaagggcagctgggctcagctgagccaagcagagaaggtggccttgtaccggctccagttccacgagaccttcgcagagatgaaccatcgctccaacgaatggaagacagtaatgggctgcgtcttcttcttcattggattcacggctctggtgatttggtggcagcgggtctatgtgttccctaagaaggttgtcaccctgacggaagaacggaaagcccagcagctccagcgcctcctggacatgaagagcaaccccatacagggcctgtctgcccactgggattacgagaagaaagagtggaaaaagtgaccaacatcacagtctgctgcctgcccttgcaaaccgattccgcttccgcagcctaggagaccctcctctcctctcttctcctcccttcccctcccccacctcctgtcttgtctcctccattcccttctgctccaataaaagcagcctgcattgttctgcctgc

SEQ ID NO: 1998 - DNA, 1095 bp, Rattus norvegicus
  Genbank Accession No. NM_053475
aaattgcaagcgtattcttttaatgactccagtaaaattaagcatcaagtaaacaaaagtggaaaagaacctacacttttaacttgtctcactagtgcctaaatgtagtttaaaggctgcttaaattttgtgtgtagttggattttttggaagctgaaggtatccatctgcagacattgaggcccaagttgaatttggattcgagtggattcttaacacttctgcctgtgctgaagagaagcttcataaggaacaagcaagttgaatagagaagatagtgatcaataagaggcatttagtggtctttttaatgttttctgctgcgaaacatttcaagatttattgatttttttttttcattttccccaccacactcacacacgcacgctcacactttttatttgccataatgaaccgtccagcccctgtggagatctcgtacgagaacatgcgttttctgataactcacaacccagccaatgcgactctcaacaagttcaccgaggaactcaagaagtacggagtgacaactttggtccgagtttgtgatgctacctatgacaaagctccagttgaaaaagaagggatccacgttctagactggccatttgatgacggagctccgccccctaatcagatagtagatgattggctaaacctgttaaagaccaaattccgggaagaaccaggctgctgtgtcgcagtgcattgtgttgcaggattgggaagggctcctgtgctagttgcacttgcactgattgaatgcggaatgaagtatgaagatgctgttcagtttataagacaaaaaagaagaggagcattcaattccaaacagctgctttacttggagaaataccgacctaagatgcgattacgctccagagataccaacgggcactgctgtgttcagtagaagcagaggaaggccggctggatcgtggcattagagggaactctgggtacctggaaatgtgaatctggattcttacctgtgtcatcaaagtagtgatggattccgtactcctcgactcctcatgattgagaagaaggcaaacgataaagaaatccctctataacacgaataaaatgtttaag

SEQ ID NO: 1999 - DNA, 1836 bp, Rattus norvegicus
  Genbank Accession No. NM_053480
atggccgtgtccacccagcagctggcggaggagctacagatcttcggcctggactgcgaggactccctgctggagaaattggcagagctgtgtactctgtaccgacagactgaggagaggatggtgagcgagctgatcgccttctgcaccagcgcagggaaatcgtgcctcactggagagatcctcagttcctttgagcacgaggttctgaacaaaaagctctccaaagcctgtcacagtgcctccaaagacaacaggcacgcaggagccagagatattgtttccatacaagagctaattgaagcagaggaggaagaggagacccttctgagcgcttacaccacaccctctaagggtcctcacaagcgagttagcagcaccccagaaacccccctaaccaaaaggagtatctctactcgcagcccacaccagcttctctccccatcgagtttctccccaagtgctaccccttcccagaaatacagctccagaaccaaccggggagaagtggtcaccacctttggctcagcacagggcgtgtcttggtccgggagaggaggctctggaagcatcagtctgaaggtcatggggtacccagaaccactcaccagcagctataaaactatgtttcagcagctcccggatattcgggaagttctgacctgtaagatagaggagcttggcagcgagctgaaggaacattacaagatcgaggcgtttacccctctgctagtcccagcacaggaacctgtcatcctgctgggtcagattggctgtgacagcaacgggaggctaaacagcaagtcagtgatcctcgagggagaccgggagcactcctctggcgctcagattccggtggacgtgtccgaactcaaagactactctctgtttcctgggcaggttgtaattatggaaggattcaacaccactggcaggagacttactgccaccaaactctatgagggtgtgccacttccgttctatcagcccactgaagaggagggagattttgagcagactatggtgttagttgcctgtgggccttataccacctctgacagcatcacatacgaccccctgcttgatctgatcagcaccatcaaccatgaccggccagatgtctgcatcctgttcggccctttcctggatgctaagcatgaacaagtggagaactgtaagttgacaagcccattcgaagacattttcaagcagtgcctgagaacagttatcgaaggaacgagaagctccggctcccaccttgtctttgtcccgtctctgagggatgtgcaccacgagccagtctacccacagccacctttcaccttctccgaactgcctcgagaggacaagaagcgagtgcagtttgtgtcagagccctgcaacctctccataaatggggtgatgtttggtttgacatccacggacctgctgttccacattggggccgaggagatctgtagctcctctgggacttcagacagattcagccgaatcctcaagcacatcctgacgcagagaagctactacccactttacccaccccacgaggacatggccatagactacgagaacttctatacctatgcccagctgccggtcacccctgatgttttcatagtgccatcagagctgaggtacttcgtgaaggacatcttcggctgtgtctgtatgaatcctggacggctcaccaaaggacaagtgggcggcacctttggccgcctctacctcaggaggcagcccaagggcacggacagtgaggggaggcaggggctgagtgtggctgcgcaggtggtcagaatctgagtcttcagcctgggttgtctggcctcacagaca

SEQ ID NO: 2000 - DNA, 1886 bp, Rattus norvegicus
  Genbank Accession No. NM_053483
tctgcagcaaccatgtccaccaatgagaatgctaactcaacagctgcccggcttaacagattcaagaacaaggggaaagacagtacagaaatgcggcgccgccgaatagaggttaatgtggaacttaggaaagctaaaaaagatgaccagatgctgaaaaggaggaatgtcagctcattccctgatgacgctacttctccactacaggaaaaccgaaacaaccagggtactgtaaattggtctgttgaggacattgttaaaggcataaacagtaacaatttggaaagccagctccaagctactcaagctgctcggaaactgctttcaagagagaagcagcctcctatagacaacatcatccgggctggtttgatcccaaaatttgtgtccttcttgggcaaaacggattgtagtcccattcagtttgaatctgcttgggcgctcaccaacattgcttctggaacatccgaacagaccaaagctgtggtggatggaggtgctatcccagcatttatttctctcttggcgtcgccccatgctcacatcagcgagcaagctgtgtgggctcttggaaacattgcaggtgatggctcagttttccgagacttggttatcaaacatggtgcaattgacccactgttggcacttctcgcagttcctgatctgtcatccttggcatgtggttacttgcggaatcttacctggacactttcaaacctctgtcggaacaagaatcccgcaccccccttagatgctgttgagcagatccttcctactctagttcgactcctacaccacaacgatccagaagtattagcagactcctgctgggccatttcctatctgactgatgggccgattgagcgcatcgagatggttgtgaagaagggagttgttccccaacttgtgaagcttttaggagctactgaactgcccattgtgacgccggcactgagagccatagggaatattgtcaccggaacagatgaacagactcagaaagtgatcgatgcaggggcacttgcagtctttcccagcctgctgacaaaccccaaaactaatattcagaaggaggccacatggacaatgtcgaacattaccgccgggcgccaggaccagatacagcaagtggtgaatcacggcctcgtcccatttctcgttggtgtcctctctaaggcagactttaagacacagaaggaagccgcatgggctataaccaactacaccagcggcgggactgttgaacagattgtgtatctggttcattgtggaataatagaacccttgatgaacctcttgagtgcaaaagataccaaaattattcaggttattcttgatgctatttcaaatatctttcaggctgcagagaaactaggtgagacagaaaaactcagtataatgattgaagagtgtggaggcttggataaaattgaagccctacagagccatgagaacgagtctgtgtacaaggcctcgttgaacctaattgagaagtacttctcagtggaggaagaggaagatcaaaatgtggtgccagaaactacctctgaaggcttcgccttccaagttcaggatggagctcccgggacctttaacttctaatgtccagccaaagcacaaagttgttagctatgtgctgtgctgtgctgtgttctcataaatttgtcttactgtttctctactaagaactctttttaaatgtggtttgttattgtagcactttttacaaaagaaactatacttgaacagttataaactgtacatactctatgaagctgtcctctgagtttatttctatgtggaatttcgtaccctgtcgggtcctgtaaataaagatttaagttccattcttcttttaaaaaaaaaaaaaaaaaaaaaaactcgag

SEQ ID NO: 2001 - DNA, 291 bp, Rattus norvegicus
  Genbank Accession No. NM_053485
cagtggtcagtcatggcatgccccctggatcaggccatcggccttctcgtggctatcttccacaagtactctggcaaggagggtgacaagcacaccctgagcaagaaggagctgaaggagctgatccagaaggagctcaccattggtgctaagctgcaggatgctgaaattgcaaggctgatggatgatctggaccgtaacaaggatcaggaagtaaacttccaggagtatgttgccttcctgggggccttggctttgatctacaatgaagctctgaaataaaatgggaag

SEQ ID NO: 2002 - DNA, 1194 bp, Rattus norvegicus
  Genbank Accession No. NM_053487
agagagagagagagagagagagagagagagaacccacccacccggcgactaatctgatcccggctgtcccccgggaccagcgaggtcccagaagacccacgagggagcgggcgtaacgcgtggctgcgggtgggagccatggacgccttcatccgagtcgccaaccaaagccaaggtcgggaccgacttttcagagccactcaacacgcatgcatgttgcttagatatttgttagagtctaaggctggcaaagaggcggtggtaacgaagctcaagaatctggagactagtgtgagcactggccgtaaatggttcagactaggcaacgtgctccatgccatccaggccactgagcagagcatccaagccactgaccttgtgccccgcctatgcctaacattagccaacctgaaccgcgtggtttattacatctgtgacactgtcctctgggcgaagagtgtgggtctgacatctggaatcaacagagagaagtggcaaatgcgggcggcccgccactactactatttcctcttgctgagcctggtccgggatctgtatgaggtcttgctgcatatgggacaagttgcacgcgacagagcaaagagagagaagtcctccggggaccctcctaagtacagcgtcgctaatgaagaaagtgaatggctccagtccttcctcctcctcctcttccagtctctaaagcgaaatccgcccttattcctggacaccgtgaagaacttctgtgacatcctgatccctttgaaccagctcgggatctacaagtccaaccttggcgtggtaggatttggaggtctcgtgtcctctgtggctggcctcatcactgtggtgtatcctcagttgaaactgaaggcccgctagggtgtttggaaaatttaagactgacgttcagtggagcaaacatttgcttttgtcatgatgtctactgtacttaattttttttaatcatgtgagcatcttaccaaccggtgatgtgagcagaggtaggacccacaacggagcctgaagactgatgacgtttttgtaaacacggcagtaacttctgcacatttccccttcagtgacttctgactactgcaaaaacatttgtgccgtcattgaagacgtgtaaaggggaagtcagaacattgctgagcatcttttctgtacatagtaagagctcatatatctaacaaa

SEQ ID NO: 2003 - DNA, 2761 bp, Rattus norvegicus
  Genbank Accession No. NM_053506
cgggcagatcgcggggcgcactcggttgcgcgctgagctaggggtgcaccgacgcaccgcgggcggctggagctcggctttgctctcgctgcagcagccgcgccgcccgccccactccgctcagattccgacaccagccccctctggatcgccctcctggactctagcccgggctcttgctccgaccccgcggaccatgctccgggcgccccccggaaaaccgggctgggcgaagagccggcaaagattaggctcacgagcgggggccccacccggccacccagctctccgcccgtgccctgcccggtgtccccgagccgtgtgagcctgctgggccatggagcgcgcgccgcccgacgggctgatgaacgcgtcgggcactctggccggagaggcggcggctgcaggcggggcgcgcggcttctcggctgcctggaccgctgtcctggctgcgctcatggcgctgctcatcgtggccacagtactgggcaacgcgctggtcatgctcgccttcgtggcggattcgagcctccgcacccagaacaacttctttctgctcaacctcgccatctccgacttcctcgtgggtgccttctgcatcccattgtacgtaccctatgtgctgaccggccgttggaccttcggccggggcctctgcaagctgtggctggtggtagactacctactgtgtgcctcctcggtcttcaacatcgtactcatcagctatgaccgattcctgtcagtcactcgagctgtctcctacagggcccagcagggggacacgagacgggccgttcggaagatggcactggtgtgggtgctggccttcctgctgtatgggcctgccatcctgagttgggagtacctgtctggtggcagttccatccccgagggccactgctatgctgagttcttctacaactggtactttctcatcacggcctccaccctcgagttcttcacgcccttcctcagcgttaccttcttcaacctcagcatctacctgaacatccagaggcgcacccgccttcggcttgatgggggccgtgaggctggcccagaacccccaccagatgcccagccctcgccacctccagctccccccagctgctggggctgctggccaaaagggcatggcgaggccatgccgttgcacaggtatggggtgggtgaggcaggccctggtgttgaggctggggaggctgccctcgggggtggcagtggtggaggtgctgctgcctcgcccacctccagctctggcagctcctcaaggggcactgagaggccacgctcactcaaaaggggctccaagccatcagcatcttcagcatccctggagaagcgcatgaagatggtgtcccagagcatcacccagcgcttccggctgtcgcgggacaagaaggtggccaagtcgctggccatcatcgtgagcatctttgggctctgctgggcgccgtacacgctcctaatgatcatccgagctgcttgccatggccgctgcatccccgattactggtacgagacgtccttctggcttctgtgggccaactcggccgtcaaccccgtcctctacccactgtgccactacagcttccgcagagccttcaccaagctcctctgcccccagaagctcaaggtccagccccacggctccctggagcagtgctggaagtgagcagctgccccacccttctgaggccaggcccttgtacttgtttgagtgggcagccggagcgtgggcggggccctggtccatgctccgctccaaatgccatggcggcctcttagatcatcaaccccgcagtggggtagcatggcaggtgggccaagagccctagttggtggagctagagtgtgctggttagctctgccgccacattctccttcaccacacagaagagacaatccaggagtcccaggcatgccttccacctacacacacacacacacacacacacacacacacaccacagtgcagtgccagtgatgtccccttttgcatatttagtggttggtgtcctccctaatgcaaacctcggtgtgtgctcccggctccggccctggcaatgcgtgcgtgcgccctgcatgtgctcacacccgccacacacccgcccgccacacacttgcaacacctcctctctcccagaagagctggggacgatgccctttgctgccactgtctcttgcttaatcccagagcctggctccttatcccccactctcccttcaactctgccccacaaagtgtcgagcgcctcgggaaacttgaagcttctctgctccttccactctggatgttttcaggaagatggaggagaagaaaacacgtctgtgaacttgatgttccttggatgtttaatcaagagagacaaaattgccgaggagctcggggctggattggcaggtgtgggctcccacgccctcctccctcagtgctgcagcttccggctgagccgcgccagctgcttctgcctgccccgcccccaggcttgggacgatggccctgccctgcttgccccgtctgtacaatcagaatttgggggtgggtggttatggggtagagcggctcttcactgtgccctaaaggtcctgaggctcacaggacagtcagcaggagagcaggcaggcccgcgacacctgggaggaatgctttgcctcgtcctgtgtactcacctcaggcttctgcatgctctgctgcccttgtgccctggtgtgctgcctctgccaatgtgaaaacacaataaagtgtatttttttacgg

SEQ ID NO: 2004 - DNA, 1857 bp, Rattus norvegicus
  Genbank Accession No. NM_053523
aagacaccaagtgtcgttgtggggtcgcagacggctgcgtcgccgcccgttcggcatccctgagcgcagtcgagcctccagcgccgcagacatggagcccgagccacagcccgagccggtcacgctgctggtgaagagccccaatcagcgccaccgcgacttggagctgagtggcgaccgcggttggagtgtgagtcgcctcaaggcccacctgagccgagtctaccccgaacgcccgcgcccagaggaccagaggttaatttattctgggaagctgctgttggatcaccaatgtctccaagacttgcttccaaagcaggaaaagcgacatgttttgcacctcgtgtgcaatgtgaggagtccctcaaaaaagccagaagccagcacaaagggtgctgagtccacagagcagccggacaacactagtcaggcacagtatcctggggattcctcaagcgatggcttacgggaaagggaagtccttcggaaccttcctccctctggatgggagaacgtctctaggcctgaagccgtccagcagactttccaaggcctcgggcccggcttctctggctacaccacctacgggtggctgcagctctcctggttccagcagatctatgcaagacagtactacatgcaatacttggctgccactgctgcttcaggagcttttggccctacaccaagtgcacaagaaatacctgtggtctctacaccggctcccgcccctatacacaaccagtttccggcagaaaaccagccggccaatcagaatgcagccgctcaagcggttgttaatcccggagccaatcagaacttgcggatgaatgcacaaggcggccctctggtggaagaagatgatgagataaaccgagactggttggattggacctactcagcagcgacattttccgttttcctcagcattctttacttctactcctccctgagcagattcctcatggtcatgggcgccaccgtagtcatgtacctgcaccacgtcgggtggtttccattcagacagaggccagttcagaacttcccagatgacggtccccctcaggaagctgccaaccaggaccccaacaataacctccagggaggtttggaccctgaaatggaagaccccaaccgcctccccgtaggccgtgaagtgctggaccctgagcataccagcccctcgttcatgagcacagcatggctagtcttcaagactttctttgcctctcttcttccggaaggcccaccagccctagcaaactgatggcccctgtgctctgttgctggaggctttcacagcttggactggatcgtcccctggcgtggactcgagagagtcattgaaaacccacaggatgacgatgtgcttctgtgccaagcaaaagcacaaactaagacatgaagccgtggtacaaactgaacagggcccctcatgtcgttattctgaagagctttaatgtatactgtatgtagtctcataggcactgtaaacagaaggcccagggtcgcatgttctgcctgagcacctccccagacgtgtgtgcatgtgtgccgtacatggaagtcatagacgtgtgtgcatgtgtgctctacatggaagtcatagatgcagaaacggttctgctggttcgatttgattcctgttggaatgttgcaattacactaagtgtactactttatataatcagtgacttgctagacatgttagcaggacttttctaggagagacttattgtatcattgctttttaaaacgcagtgcttacttactgagggcggcgacttggcacaggtaaagcctttgccgggttttctgttcaataaagttttgctatgaacgacaaaaaaaaaaaaa

SEQ ID NO: 2005 - DNA, 2175 bp, Rattus norvegicus
  Genbank Accession No. NM_053525
gtaaagatggattcctacgatctgtttcgccggctcggagccggcgccaagttcgacgtgaagcggttctcagcagacgctactcgattccaggtaggaaaaagaaaattcggttctgattcttcagagaccgtgaagggactagacttcttcggaaacaagaaatctgtctcagatgagtgtggaggattacaaacacagcaggagctccaaaatgaggagacaacagaagggggcctgctggaaaggagtaaggagccgaagaagaaaaagagaaagaagatgactgcagacgttcctgctcaagaagaccttgacgggacgatacagtggacatcctctgtggaagcaaagcttcaagataaaaaagccaatggagagaagaaattaacttcagaaaagttggagcatctcagaaaggaaaagatcaacttctttcggaacaaacacaagatacatgtccaaggaactgatcttcctgacccaattgctacatttcagcaacttgatcaagaatataagatcagtcctcgattgctccagaatattctagatgcaggcttccaggtgcccacaccaattcagatgcaagccattccagttatgctgcatggtcgggaacttctggcttctgctcctactggatccgggaagacgttggcatttagcatccccattttaatgcagctgaaacaacccacaaataaaggctttagagccctggttatatccccaacccgagaacttgccagccagattcacagagaattaattaaaatatctgagggtacaggattcaggatacatatgatccacaaagctgcaatagcagctaagaaatttggacctaaatcatctaagaagtttgatatccttgtgaccactccaaatcgactgatctacttgctgaagcaggagccgccagggatagacctaacaagtgttgagtggctggtagtagatgagtcggacaaactgttcgaagatggcaaaactgggtttcgagaccagctggcttccattttcctggcctgcacatcccccaaggtcagaagagcaatgttcagtgcaactttcgcatatgacgttgagcagtggtgcaagctcaacctggataacatagtttccgtatccattggagcaaggaattctgcagttgaaactgttgaacaagagcttctgtttgttggatcggagactggaaaacttctggccatgagagaacttgttaaaaaaggcttcaatccacctgtccttgtttttgttcagtccattgaaagggctaaagagcttttccatgagctcatatatgaaggtattaatgtggacgtcattcatgcagaaagaacacagcagcagagagataacacagtccacagcttcagagcaggaaaaatctgggttcttatttgtacagccttgcttgcaagagggattgactttaaaggtgtaaacctggtcatcaattatgatttcccaaccagctcagtggaatacatccataggataggtcgaactggaagagcagggaataggggaaaggctgttacatttttcaccgaagatgataaaccattactaagaagtgttgccaatgttattcagcaggctggttgtcctgtacctgaatacatcaaaggtttccagaaactactgagcaaacaaaagaaaaaaatgattaagaagccattggaaagggagagcattagtacaactccaaaatatttcttagagcaagctaaacagaaaaaggttgctggccaaaacagcaagaagaaagaaactcttaaaggaaaaagttaaaaataaacaccctgcagtgcaatttatgaactcggcatgaattctcatggagtacctacaactatctttaccaaacattttaagtcaacaagggtatgagagaacaaaatggtcctgatttagtgacttgtcaagcttcactttgtaaatgggatttatacaatggaaataacatgcattgacatttctgcctgaatctagagagctacttcttatagaagaacaaagctgatgctaaaataacacccatgtggtgaactcttaaggattttgcccttcaagtgtgaaggaaagtgtgatgcatgctgtggagaggcatctggaacagaattttaaaataaaaccttgagctcgcaaaaaaaaaaaaaaaaa

SEQ ID NO: 2006 - DNA, 1309 bp, Rattus norvegicus
  Genbank Accession No. NM_053538
gaagaggggaccgtgcaccatggcctcccgtgcagtgccagtcaggcagacatgctgttgtttcaatgtccgagttgccaccgtagccctggccatctaccatatagtcatgagcgtcttgctgttcattgagcatgtggtggaggtggcccgcggtaaagtctcctgcaggttctccaagatgccatacctcaggctggctgacctgctctccagcttcctgctcatcggagtcctcttcattatcagcctcagcctgctgttcggagtggtcaagaaccgggagaagtacctgatacccttcctgtcccttcaaatcatggacttcctgctgtgcctgctcacactgttgggctcctacatcgaattaccagcatacctgaagtttgcccggccccggcccggtccttctaaggtacccttgatgacactgcagctgctggacttctgtttgagcatcctgaccctgtgcagctcctatatggaagtgcccacctaccttaacttcaagtccatgaaccacatgaattacctgccgagtcaggagggcatgccacgcagccagttcatcaacatgatgctcatcttttcagtggcctttatcaccgtgctcatcctgaaggtctacatgttcaagtgtgtttggacatgctacagattcatgaagcacatgaattcggccgtggaggacagcagttccaagctgttcctaaaggtggctctgccgtcctatgaggaagccttgtctctgcccactaagactccagagggggaccctgcaccacccccatactcggaagtgtgattcccaccaggctttcagcccttgggctgggagaggcggaactccccgcctcctgcttcttcactttgatggctgccatggcctactacaggacagtctgcttgtgcaccccccctcactgtcctctctgcttggggacctcttactcacaacagagtcaccctgggctaaatgaccctttgaagctcagagtactcagcctagcatctcatctagtcttcatcagcaatgatacttgttcagagaacagtcgtggcaaattagggggagttggttaacaactactggcttgatctgtttagctagatagccaacaccagcaggggcagcaggaagagaatctggccaagcaacaattcctggtgtcagtccatactcagctgtcatgggtcgtgggtcatgggtcatgggtcatggatcatgggtcatgatcatggtgcccatttgctacccccaagtacccaaaagtgtacaaataaaacaacaacaacaaaacaaacaaac

SEQ ID NO: 2007 - DNA, 1182 bp, Rattus norvegicus
  Genbank Accession No. NM_053539
ggaagcttccccaccgcaaagcagctagacgtgcgggcagtctcagctgtccactgggagtcgccaacaccatctcttgggctccagggtcgcaatcactaccggggatctccagcaagtcttccggacccacgcgtagaggaggtggtgccaccgcgcgcaaacctggcgcggtcgtgacgtcaggactacgctagattggcaattggctggaggcatgtggcgcggacgggcactggcaggagtgattggatcagctcttaaggggcggggtctggaggcggagcatgctgccgagagcgttgaagtacggcgctccgcacagcttctcgacactcctgtctggaatcgctgtgttctaggtcagatcagacattctgtcacaatgcctgaaatcaatgccagcaatcttgatgaaaaacaggttcagcttctagcagagatgtgtattcttattgatgaaaatgacaataaaattggggctgacaccaagaaaaattgtcacctgaatgaaaacattgacaaaggactaatacatcgagctttcagtgtcttcttgtttaatactgaaaacaagctcctgttacagcagagatcggatgctaaaattacctttccaggttgtttcaccaatagttgctgtagtcatccattaaataaccccggggagctggaagaaaatgatgccatgggtgtcaaacgagcagcacagaagcgcttaaaggcggagctggggatacccttggaagaggttgatctaaatgaaatgaattatctaacaagaatttactacaaggcccaatctgatggtatctggggtgaacatgaaattgattacattttgtttctgaggaagaatgtaaccctgaatccggatcccaacgagattaaaagctattgctatgtatcaaaggaagaactcaaagaaattttgaagaaggaagccaggggcgaaattaagtttactccatggtttaagattattgcagacgcttttctctttaaatggtgggataacttaaaccatttgagtccttttgttgaccatgagaaaatacatagaatgtgaatgtgtaaatgatttgagatttttttctacctactaagaatggtttgattttgttttaaattgggctcccttgtatgacacatagatattttacaaccagaatttgttttgag

SEQ ID NO: 2008 - DNA, 1511 bp, Rattus norvegicus
  Genbank Accession No. NM_053563
tgggctcaaggaaggaagcgttgtagctcgcgtccaggggcgcggcgtgtacgggtggctctcttcgcagctcgcggaggcgaaccgggcaacagtgacatggcagaacaggatgtggaaaatgagcttttggattatgatgaagatgaagagccccaggtaccccaggagagcactccagctcccccgaagaaagatgtcaaaggatcttatgtctccatccacagttctggcttccgggactttctgctgaagccggagctcctgagagctatagttgactgtggctttgaacatccttcagaggtccagcatgaatgtattccccaggccattctgggtatggatgtcctgtgccaagccaagtctgggatgggcaagacagctgtgtttgtgctggccaccctgcagcagattgaacccatcaatggccaggtatcagtactggtcatgtgccacacaagggagctggccttccagatcagcacggagtatgagcgcttctcgaagtacatgcccagtgtcaaggtatctgtgttctttggaggcctctccattaagaaagatgaagatgtgttaaagaagaactgtccccatgttgtggtggggacaccaggccggatcctggccctcgtgcggagcaggagcctcaacctgaggaatgtgaagcactttgtgctagatgaatgtgacaagatgctggaacagctggacatgcgccgggatgtacaggagatctttcgtctgacaccccatgagaagcaatgtatgatgttcagcgccaccctgagcaaggagatccggccagtctgcaggaagttcatgcaggatcctatggaggtgtttgtggacgacgagaccaagctcacactgcatgggctgcagcagtattacgtcaaactcaaggacagtgagaagaatcgtaaactcttcgacctccttgacgtgctagagtttaaccaggtggtgatctttgtcaagtctgtgcagcgctgcatggccctggcccagctcctagtggaacagaattttccggctatcgctattcacagaggcatggcccaggaggagcgcctgtcccgataccagcagttcaaggacttccagcgtcgcatcctagtggctactaatctgtttggcagaggcatggacattgagagagtcaacatcgtcttcaactatgacatgccagaggactcggatacctacctgcaccgagtggctcgtgctggtcgctttggtaccaagggtctggcagtcacttttgtgtcagatgagaatgatgccaaaatccttaatgacgttcaggaccggtttgaagtgaatgtggctgagcttccagaagaaatagatatctccacatacattgagcagagccggtaaccatgtgtgtagccaggcacatggctttctctcctgctgcttcagatcctcctcctaggtggcaatcggcggcctctctttttattgttccaaagctttagctatgttaagaataaacttttattgtg

SEQ ID NO: 2009 - DNA, 2759 bp, Rattus norvegicus
  Genbank Accession No. NM_053573
aacctggtggcccttctcgacagcggagcgcgcggggacgctgcagcggcgggcaacgcgggcaggcagcgcgctccaggcagggccgcctggtcacctcccggcgccggggcggcgcggcgatggccagggcgcagagggaggcagagaccggcgggcgacggcgggcggagggggcgcggggacgcggccgggcgcccctgcccgccctggtgcccgccgcctaaggctgcccggggcgcgggagccggcgccggcgcggcgcgggcgcaggagaccactcgaggcgcgatgtcggtgccgctgctgaagatcggggtcgtgctaagcaccatggccatgatcaccaactggatgtcccagacgctgccctcgctggtgggcctcaataccacccggctctcggccgccagcggcgggacgctggaccgcagcaccggcgtgttgcccaccaaccccgaggagagctggcaggtgtacagctctgcccaggacagtgagggcaggtgtatctgcacggtggtcgccccccagcagaccatgtgttcacgggatgcccgcacaaaacagctgaggcagctactggagaaggtgcaaaacatgtctcaatccatagaagtcttggacaggcggactcagagagacctgcagtacgtggagaagatggagaaccagatgaaaggcctggagtccaagttcaggcaggtggaggagagccataagcagcatctggccaggcagttcaaggcaataaaagcgaaaatggatgaacttaggcctttgattcctgtgttggaagagtacaaggccgatgccaaattggtattgcagtttaaggaggaggtccagaatctgacgtcagtgcttaacgaactgcaagaggaaattggcgcctatgactacgatgaacttcagagcagagtgtccaatcttgaagaaaggctccgtgcatgcatgcaaaaactagcctgcgggaagctgacaggcataagtgacccggtgactgtcaagacctcaggctcaaggttcgggtcctggatgacagacccactggccccagaaggtgataaccgggtctggtacatggatggttatcacaacaaccgctttgtccgtgagtacaagtccatggtggacttcatgaacacggataattttacctcgcaccgtctcccacacccctggtcgggcacgggccaggtggtctacaatggctccatctatttcaacaaattccagagtcacattatcattaggtttgacctgaagacagagacgatcctgaagacgcggagcctggactacgctggctacaacaacatgtaccactatgcctggggcggccactcagacatcgacctcatggtggacgagaacgggctctgggccgtctacgccacaaaccagaacgcaggcaacattgtcatcagcaagctggatcctgtctcactgcaaatcctccagacctggaacaccagctaccccaagcgcagcgccggcgaggccttcatcatctgcggcaccctctacgtcaccaacggttactcggggggcaccaaggtccactatgcctaccaaaccaacgcctcgacctacgagtacattgacatccccttccagaacaaatactctcacatctccatgctggactacaaccctaaagaccgcgcgctgtacgcctggaacaacggccatcagaccctctacaacgtcaccctcttccacgtcatccgctccgatgagttgtagctcccgcttttccagaagccaagggtccaagtcctcaccccgaggacattttccataaaacagctgccaaatgattccaagaatactataacagtcctgattttgagaaatcagcgcaattttgacgccgagagatggtgtcctctctgtgttcctcctgctcgtgcaggtgggccacagatttcagaagaaaccgccatgtatgtggatggaactgcagcccaaggctccttggctgtccccatcccaccccatccctctctggtccaataactcaaagaagcaaggcgatgactgttggcccctctcacccaagaacaacccactgctaagattgcatggacatttccttaggtcgtgcccagcgagatgacgtgatggccattctccccacccacagcccccagcccccgtggcgctcggtgtaggctgcttcggcccacacgtatcgcagctgcctttttcttgactgtgttgttgtctcttagattaactgtgctgagactcccggtagctcatggacctgtgtctagtactttcccgaagcgatggtgggtgtgcgtagagtgaagttgctgtacccacgttgttgaacttgcgtaccctgtagctagatcgtgaggtgtccgtctgttatcccccccaaggtggtaactccgtgtgttcaatttatgcaatgaatgttgtcatgcgatgctgtagtttggattgataagtggatggtttctgtttctaaaaagaaaaaaaaatcagtgttcgcccttataggagacatagtcaagttcatgttgataataacccagtgaaattcttctcttgtcaagttatctgaattgtgtaaccatagatgggaaggacgcatcttgggaaacttcagtttcctacgggaaggaactccccaagggcagccatgtgtgaaaagatcattttttaaagaaaaaaaaaataagtcaaagagggcaactttgtactattcagttatctaaggaacaataaagatattaggagat

SEQ ID NO: 2010 - DNA, 1414 bp, Rattus norvegicus
  Genbank Accession No. NM_053576
gcgcctccttgttcccagcgtcaccactgccgccatgcccggagggctgcttctcggggacgaagcccccaactttgaggccaataccaccatcggccacatccgcttccacgatttcctaggagattcatggggcattctcttttcccacccacgggactttaccccagtgtgcaccacagaacttggcagagctgcaaagctggcgccagagtttgccaagaggaatgttaagttgattgctctttcaatagactctgttgaggaccattttgcctggagcaaggacatcaatgcttacaatggtgcagcacccacagaaaagctaccatttcccatcatcgacgataaggacagggaccttgccatcctgttgggcatgttggatccagcagagaaggatgaaaaaggcatgcccgtgacagcccgtgtggtattcatttttggccctgacaagaaactaaaactgtccatcctctacccagccaccacgggcagaaactttgatgagattctcagagtggttgactccctccagctgacagcatcaaatccagttgccactccagttgactggaagaagggagagagtgtgatggtccttcccaccctccctgaagaggaagccaaacaacttttccctaaaggagtcttcaccaaagagctcccatctggcaagaaatacctccgttatacgccccagccttaagtctgcgggaactggggctgcaactgctcgaccagcactgggacctgaggatgacagctgacagctgcagttccgtagaaagattgtggcgtggtcacagccgaagtcgcgtaggtcgctcgctatactactggctcattaaatggaaatggcaccaaaacattctcgggattctttactctgtgccttcgccagcattctgcccctccatccatcacagcgccctgctgactggctttctttgaaacgaattatgtgttggtgactgcagggtctctgcagggtctgtgatcagcaaggtagtgtcagtgtgggctccatgctagaatgataaacatcttttgtaggtttccaaactgaatcttctgttacccattgtggagaaccataaagtggggagaaactttcaattctgtactttcagtaaataaagcaggggaggtggggggggggggagagttctctataggaaatccatggtgagtttctatcaaagtgggcttccaagaatgtgtggaagacagcacatgtacttcctggagtttccaggtctgctctctagtgatctgtgaatgtgaactcgccttatgaaagacaggcagtgacattgtttgccactaaatgtcctaaaggagtgggttgccatttctaaattctgctgtgtgaggttcaacaataaaatcctgattagaaaaaaaaaaaaaa

SEQ ID NO: 2011 - DNA, 1869 bp, Rattus norvegicus
  Genbank Accession No. NM_053582
ccaccatgtggggatgtccgctagggctgctattgctgctgctggctggccaggctgccctggaggcccggcggagtcgttggcgcagggagctggcgccagggctgcacctgcggggcatccgggacgccggtggcagatactgccaagagcaggacatgtgctgccgcggccgtgctgacgagtgtgctttgccctacctgggagccacctgttactgtgacctcttctgcaaccgcaccgtctctgactgctgccctgacttttgggacttctgcctcgggattccaccccccttccctcctgtccaaggttgcatgcatgcgggccggatctacccaatcttcggaacctattgggaaaactgcaatcggtgcacctgccatgagaaagggcagtgggaatgtgaccaggagccatgtctagtggacccagccatgattaaagccatcaaccggggcaactacgggtggcaggctgggaaccacagtgccttctggggcatgaccctggatgagggcattcgataccggctgggcacaatccgcccatcttcctctgtcatgaatatgaatgaaatttatacagtgctgggacaaggagaagtgctacccactgcctttgaggcttccgagaagtggcccaacctgatccatgagccgctggaccagggcaactgtgcgggttcctgggctttctccacagcagctgtcgcatctgaccgagtgtccatccattctttgggacacatgacacccatcctctcaccgcagaacctgctatcctgtgatacccaccaccagaagggctgccgaggtgggcgtctcgatggtgcttggtggttcctgcggcgccgaggggtggtgtctgataactgttacccattctccggccgtgagcagaacgacgaggccagccccactcctcgatgcatgatgcacagccgcgccatggggcggggcaagcgccaggccacttctcgctgccccaatagtcaggttgattccaatgacatctaccaggtcacgcctgtctaccgcctggcctccgatgagaaggagatcatgaaggagctaatggaaaatggccccgttcaagcgcttatggaagtacacgaagacttcttcttgtaccagcgaggcatctacagccacacacctgtaagccaggggaggccagagcagtaccgccgacacgggactcactctgtcaagatcacagggtggggagaagagacactgccagacggaaggacgatcaagtactggactgctgccaactcgtggggcccatggtggggtgagaggggccacttccgaatcgtgcgtggcatcaacgagtgtgacatcgagaccttcgtgctgggcgtctggggccgcgtaggaatggaggacatggggcaccactgagtctcggccactaagctaggtgggatccacagccacggaagaggccttgggggccacgccgatgaggccttgggaccaggtgctaatcccctcagactcagatccacacaaacgcagaaccccacctgggagctaatgtccctcagggagcaacagtgaggctggagggaaccctcagacatcacagccggaactggaaagggcccggcttggaaactgcagggagtaaaattcccaggcccctggtcagccagcccaagaccatgggagctaagacaccccaacctctttatcctcctacccaacctcattcttattttttcattctctttggtggattctgcccatccccctggcctccgttctggctggacctttccatcctcaacactgctttcttactctttaaaaatatttatttttcttttcattaaaataaaaccaaagtattgataattgc

SEQ ID NO: 2012 - DNA, 485 bp, Rattus norvegicus
  Genbank Accession No. NM_053586
gcttgtctcgagcgagatggcttcaaggttacttcgcggagtaggcgctttggcggctcaggccctgagggcccacggaccccgtggcgtggccgctacccgctccatggcttctggaggtggtgtccctactgatgaggagcaggctaccgggctggagagggagatcatgatagcagcacagaggggactggatccatacaatatgctacctccaaaggcagcttcgggcaccaaggaagaccccaatctagtcccatccgttagcaacaagagaatagtgggctgcatctgtgaagaggacaactgtactgtcatctggttctggctgcaccaaggcgagagccagcgatgccccaactgtggaacacattacaagttggtgccctaccaaatggtccactgagcccacccctggtttaacatttcagaatgtaaaggaaaacgtctctcaataaagactagccaacgcactggctccttcc

SEQ ID NO: 2013 - DNA, 494 bp, Rattus norvegicus
  Genbank Accession No. NM_053587
cggcacgagctccttagctttgagcaagaagatggctgccaaaacaggatctcagctggagcgcagcataagcaccatcatcaatgttttccatcagtactctaggaagtatggacatcctgacaccctgaacaaggcggaattcaaagaaatggtgaataaggacttgccaaattttctgaagagggagaaaagaaatgaaaatctcctaagagacatcatggaggacctggacacaaaccaggacaatcaactgtcctttgaggagtgtatgatgctgatgggaaagttgatctttgcctgtcatgagaagctgcatgagaacaacccacgtgggcatgaccacaggcacggcaaaggctgtgggaagtaattaagaggtcgccatgtaacatctgcccaaccaagtctaaagggaatagcttactaaatgaccttggttctggggctgggaaataatttaaaaatgaataaataaagtctttatccattcc

SEQ ID NO: 2014 - DNA, 2179 bp, Rattus norvegicus
  Genbank Accession No. NM_053591
ggcaggctgtctctctctgggtttcagccgcaggactgaagccaccttctcacccctgacctgcgtgtgctgtggccaccacggaggtgtcaaggcagctgtggaagcagatccctgaggaaccttgaaatgttgatcatctggtggttctggtctctgctggccatctgtgcttctgactccttccggaaccaggcggagaacatcatgagaaccacaccggtcattgacgggcacaacgacttgccttggcaaatgctcactctgttcaacaatcagctccggaaatcagaggccaacctgagcgcgctagcggaaacacacaccaacatccccaagctgagggctggcttcgtgggaggccagttctggtccgcatacatgccttgtgacacccaaaacaaagatgctgtgaaaagaatattggaacagattgatgtcatacatcgcatgtgccagctctatcctgagaccttcgagtgtgtcaccaatagttcagacatcctacaggcgtttcggagggggaaagtggccagtctaattggcgtggaaggtggccacttgattgacagcagcctgggtgttctgcggacactctaccatctgggcatgcggtacctgacccttacgcacaactgcaacacaccctgggccgacaattggctagtggacaaaggagacgacgaggctgagagccaaggactgtcgccctttgggaagcttgtgctgaatgagatgaaccgtctgggtgtcatgattgacttgtcccacgtgtctgtggccaccatgaaggacgctttgcagctatccaaggcaccggtaatcttcagccactcctctgcctacagcgtgtgtccacacaggcggaatgtgcctgacgatgtgctgcagctggtgaagagcacaaacagtttggtgatggtgaacttctataaccagttcgtgtcctgctcagacagcgccaccttgtcccaagtggctgaccacctggaccacatcaagaaggtggcaggcgcaggggctgtgggccttggaggagattatgatggtgttaccaaccttcctgtgggactggaggatgtctctaagtacccagacctgatagcagagcttctcaggaggaactggacagaaaccgaggtcagaggcctgctggctgaaaacctgcttcgggtcttctctgcagtggaactggtaagcaatatcatgcaagttcctgaggaagagactatccctgtggagaagctggatggctcctgcaggacattctatggccactcaagggcccccagcatccacttgcagataggggccctgttggcctctctggcttccctggtcttcagtctgcatcttctgtgacatcccaaggaccagaacctcctccagtgctctccgagctcaggaagactgagcaggcccaaagtccctgttgtccatgccaaaccacatcctttcctgaagaagcagtgggcttacctggggacagctcaagacacaggcacgcaataaacacaatgtcctttaagtgctaagtaggcatctcagccctggaaggttcgtctgagcatggagagagcagattttgtgagaacagctctgggtcaaaaggacacaggagcacctaagttcttggaggggaggactggaaggaacccagaggtctgcagagggtctcatgtgagcagtgactagtttgaaatgtcatggttcatgtttcagtggctaccttccccccattgctgtgcatgtaccacatgcacacaatcccctcgcccctacacacatgtacttatgtgcacacagccacaaacgaagacactcagatgcacatctatatcacacacaggcgcatgcactctgctgacacataccataggagagtcacacatatctatctgggttctgtagtgctgggaagggacccaggtaatctgaatttggtctaatcttggaaggtaggctccagataggatgggtgcctgcactcacgggggtatcccacacagctaacagcaggttttttccagattcacaagcttatggttatcttctgtgtgttacctagcacggttggcagtgtgaagcagggtgccaggctttccagtgaggacattcaaggatgagtcttgtgaataaacttgtgagggacagcgtgaagcagctcccctgaatggcc

SEQ ID NO: 2015 - DNA, 3565 bp, Rattus norvegicus
  Genbank Accession No. NM_053594
cacgagctcgttcccctcgcagcctcagctaagacccggagaggtggaatttcgatttgaaactccctagccagggccggggctgggcatgctcagtgcctcggtgtatcgggctgctgctagctgcacaggcagcagaggcgctgcctggcttggaagctggcacaagagtccaccccactgtcaccaccgactgcgggcttcaggaaggccaaacactcacctcctctgagcgctttacacccaccaacctcgagtccccatctcccgcagcatcctactctcccgtctccccatcccttagggagacgaagccagtgctcggttctgtaggcacgccacagactgctctgtgaaccccagcggaggaccctgtcatcggatgcctcgggatcaaaggactcttggcagtgtttctctcaaatagcactttgcctggagtgggattgcggtggagtttctcccccgcccctcaatgcacacactatgaggagagcggtcggtttccctgcactgtgcctgcttcttaatcttcacgctgcagggtgtttttccaggaacaatgaccactttttggctattcgtcaaaagaagagttggaaacccatgttcatttatgaccattcccaagacattaagaagagcctggatatcgctcaagaggcatataaacacaactaccccgccccctcagaagttcaaataagcaaacgtcaccagatcgttgattcagcatttcctagacctgcatatgacccatctcttaatctgttggctgcatctggtcaagacctcgaaatagaaaatctcccaattccagcagcaaatgtgattgtggtgacactgcaaatggatatagacaagctgaacataaccttgcttcggatcttccgccaaggagtagctgcagccctgggactcttacctcagcaagtacacatcaaccgcctcattgaaaagaagagccagattgagttgtttgtgtctcccggaaaccggaaaccaggagagccgcaggccctgcaggctgaggaagtactgcgttcccttaatgtggatgttttgcgtcagagtttaccacagtttggaagtatagacgtctcccctgagaaaaatgttttacaagggcagcatgaagcggacaagatctggagcaaagaaggcttttacgccgtcgtcatcttcctcagcatctttatcattatagtaacctgtttgatgatcatttataggttaaaagaaaggcttcagctttccttccgacaagataaagagaaaaaccaggagatccacctatcgcccattgcactccagcaagcacaatcggaggccaaggcagcccacagcatggtccagcccgaccaggcgccaaaggtgctgaatgttgttgtggaccctcaaggccaatgcactcctgagattcgaaacaccgcctccacttctgtctgcccttctcccttcaggatgaagcccataggactccaggagcgacgaggttccaatgtatctcttacactggacatgagtagcctgggcaacgtggaaccctttgtggccgtctccaccccccgggagaaggtagccatggagtacctgcagtcagccagccgagttctcacaagtccacagctgagggacgtcgtggcaagttcccacctgcttcaaagtgaattcatggaaataccaatgaactttgtggatcccaaagaaattgatattccacgtcatggaactaaaaatcgttataagaccattttgccaaatcccctcagcagggtgtgcttaagaccaaaaaatataactgacccattgagtacttacatcaatgctaattacattcggggctacagtggcaaggagaaagccttcattgccacacagggccccatgatcaacactgtgaatgacttctggcagatggtttggcaagaagacagtcctgtgattgttatgatcacgaaactcaaagagaaaaatgagaaatgtgtgctctactggccagaaaagagagggatttacggcaaggttgaggttctggtcatcggtgtcaatgaatgtgataactacaccatccgcaacctcgtcttgaagcgaggaagtcacacccaacatgtgaagcattactggtacacttcatggcccgatcacaagactccagacagtgcccagccccttctgcagctcatgctggacgtagaggaagacagactggcctctgaaggccgagggcctgtggttgtccactgcagtgcagggattgggagaaccggatgtttcatcgctacatccattggctgtcaacagttgaaagaagaaggagtcgtagatgcactaagtatcgtctgccagcttcgtgtagacaggggtggaatggtccaaaccagtgagcagtatgaatttgtgcaccacgctctgtgcctgttcgagagcagactttcgccagaaacggtccagtgactctgaagatctaccagagcgtcaatctatcacgggtgattcgtcaagttacctactgagggctccgagaaggagctccccacgatggatgaggaggctctaaagccagcctgaggcgtggattgtggaagctatggtaacttgaaagattgccacctttgtgtataggactgtgttctaggcatccccctaggtactccgaaggacctgtgctgatggaggtgtgacagtcctcatgcagcctgaggaggattctgttttgtctgtgtcgactctcacacagaacctgtatgtgtaatattcagagtctgtgcttatggtgactggaggagctgcggaagatatcgttatcctgtgttagatgctttaatgttcacaaagcctgtcttgtgactggactgtcagctgttcaactgttcctgtattaagtgctattacctatctcagttaccagagtcttgctgctaaagttgcaagtgaccgacaatggatttttaaccatgacgttttttgtttttgaaaaaaaaaaatcaaaggcagtaactattttatatggagatgtgtcttgattatctctaataagtgtgtatttatagtatctcctatggatcaattacagagcacaatgattgtcactggatatatatgtatatgtacattacaggtatatgtacgcatatatattctattattaagcatagaggtagctcctgttttacaactctaactactatatttctacattgtgacttgttttactttaaaaggggataaacaaatttatagtaactataaagtatcaataattttaaatactcatctctcttttactaagaagggatttttgaatatagtgtctacttggtttctctctcccagtaagaagcaggtgcctttggggatgctccaacctgtttcatccccgaaagtttttctgaggacaccgtcatgcacgcatgaccttaaatttctaaaaggttttcttcctcaagagaccaatgaaggcaagataaccgcactcagcaaacatgagatgttctgctcagatgtgaattttcaatgcagcaaagttgactttcgtactcccaataaatgactcttaacagcc

SEQ ID NO: 2016 - DNA, 4469 bp, Rattus norvegicus
  Genbank Accession No. NM_053596
cgtgcggtcggagcgtagagctcagcgcagagcaccgggagccggagccttagcgggaggtgcatccaaagcccggccgttcggagcccgcgagcgatgatgtcatcctacaagcgggccacgctggacgaagaggatctggtggactcactctccgagggcgatgtgtaccccaatggcctacaggtgaacttccgcagcccccggagcggacagaggtgctgggcagctcggacctcggtggagaagcggctggtggttctggtgacgcttctggcagcagggctggtggcctgcctggcagccctaggcatccagtaccggacaagaacgcctccggtatgtctgactgaggcctgtgtctcagtgaccagctccatcctaaactccatggaccccacggtagacccctgccaggacttcttcagctacgcctgtggtggctggatcaaggccaaccccgttcccgacggtcactcacgctgggggaccttcagcaacctctgggagcacaaccaagccatcattaagcatctgctggaaaattccacggccagcgcgagcgaggcagagaaaaaggcgcaagtgtactaccgtgcgtgtatgaacgaaactaggatcgaggagcttcgggccaagcccctgatggagctgattgagaagctcggaggttggaatatcacaggaccctgggccaaggacaacttccaggacacgctgcaggtggtcacagcgcactaccgcacctcacccttcttctctgtctatgtcagtgccgactccaagaactccaacagcaatgtgatccaggtggaccagtccggccttggcttgccctccagagactattacctgaacaagacggaaaatgaaaaggtactgactggctatctgaactacatggtccagctggggaaactgctgggtggtggggacgaggactccatccggccccagatgcagcagatcctggattttgagaccgctctggccaacatcaccatcccccaggagaagcgccgggatgaagagctcatctaccacaaagtcacggctgctgagctgcagaccttggcacccgccatcaactggttaccctttctgaatgccattttttacccagtggagatcaatgagtctgagcccatcgtggtctacgacaaggaatacctcagacaagtctccacactcatcaacagcaccgacaaatgcctgctcaacaactacatgatgtggaacctggtacggaaaacaagctcctttctcgaccagcgctttcaggatgccgatgagaagttcatggaggttatgtacgggacaaagaagacctgtcttccccgctggaagttttgcgtgagtgacacagaaaacaacctgggctttgccctgggccccatgtttgtgaaagcaacctttgcggaggacagcaagaacatagccagcgagatcatcctggagatcaagaaggcattcgaggagagcctgagcaccctgaaatggatggatgaagatactcggaggtcagccaaggagaaggcggacgccatctacaacatgataggctaccccaacttcatcatggaccccaaggagctggacaaagtgttcaatgactacacagcagttcccgatctctactttgagaacgccatgcgatttttcaacttctcattgagggtcacagccgaccagctcaggaaagcccccaacagagatcagtggagtatgaccccgcccatggtgaacgcctactactcgcccaccaagaacgagattgtgtttccagctggaatcctgcaggcgccattttatacccgctcttcgcccaacgccttgaactttggtggtatcggggtcgttgtggggcacgagctgactcatgctttcgacgatcaaggccgggagtatgacaaggatgggaacctccggccctggtggaagaactcgtcggtggaggcattcaagcagcagaccgagtgcatggtacagcagtataacaactacagtgtgaacggagagcccgtgaatgggcggcacaccctcggggagaacatcgcggacaacgggggactcaaggcagcctaccgggcgtaccagaactgggtaaagaagaacggagctgagcagatactgcccaccctgggtctcaccagcaaccagctcttcttcctgggattcgcacaggtctggtgctcggtccgcacaccagagagctcccacgaaggcctcatcaccgatccgcacagcccctcccgcttccgggtcatcggctcactctccaactccaaggagttctcagaacacttccgctgcccgctcggctcccccatgaaccctcgccacaaatgcgaagtctggtaagggctgaagcgcagagaacacaggtggaagaagggaaggggcctgcagccagctcccgggaacagggccgcgctgtcaccctccttccagcccctcggccgagggccccttccccaccctggagggtatgcagccatcttgtctaagcctatgccagaggctcagcactggaagccaacatttgacccccttcgaagctccagcatcccagacacccttgagtgatgctataccgggcctttgggtgtgtcaagctggtggcttgccagccctgggcctcacactgacaatggcagtgggacaggaccctttgccacgtccaatgccagatataccacaataccactgtgtcaaatgctttaaagatatattttttggggagactattttttaagcattatggaatacactggaaatcttcagggaaaatgcatttaaaacacttttttttaaaaaaagattagtatatttattatgttctctcttttttttctaaacaacctgcggacaaaggaaaccccactgattgaccccaggggaccccaggctgttgagcaggccaccagtttgagcactgctttagcccattgttggtgtaattgcttgtgcagtcaggagatgtaggggccaggcagaaggggtggccagctgaagggcctgatttatgagcatggccttctctgtcctgtctccggagtccaaccatgggaaccccaacaaggacgggctgttacccaagttgatccctatggcagtacaaagccagagtaatggcctccgtacaaccgggggacccctgaacactctggacaacatcacaggagcccgtcggggctgagaccccacaccccatcagatgcacactattgtccaaagatgtcttgttttggtcccacctcttctggccttgggaccggttgcctctctgtagcagttctgacatcctgaagtggtcgccctctgtaccaggggaaaggggaaagagaaagcagtccagttctccctccaagctccgtagcctgtagttaccctggcttggctcctgggaccccttctctagtgccttaccccaggccacagcccctgagcccctttgaggaggcagcatttgtcttgctttctcagtggagcccccaagtgtcctgactagaagccaacaccatagccccactcccagaagccccagggtaccgtcccaaaccctacaggacagccattccacacattccccaccccacccccctctgcagcaggccaagactggaaggttcccagccccatcgggctccagggaatggcaggatgtcatccacccacagcatcacctaacagatatgtgggcctccactaagtggcgctcactgaggttttcatgactgctgtagggagcaagctcttgtgacctgtgtgtgaggagcgcagtagaagtgcccatcacagcccctggcaagtcatgcccccacatagcacaacacacacacacactcacctggaagccagagtcctccttggccaagacgcagagacagtgtagtctcggtcctgctagcgtagcgatagtcttagcactgggatggggagctgcaagcgggtgtctggcaaggttcttggtccctgtgaacacattcgaggtctcagctcttcggggaaaagtaacacaggaagcaggaaggtgctggagccacgccctgccacacaggggggaccttctgggtgggatcatctgccctttctatcccctcgccctgcttccccacaggtggccgtcctggatgccagtatctagaagcagggtcctgagctggagttagccatgcacgcattgctcagggtgtgcagggagccaaggcaggaaaacccaggctggttagggatggatgggtgcaaaagcagcatcccgacccctgtccctccagagatttgagaagggcagaattaggaagggcacccgccctcagaaagagccctcctctcaagcccggagtttccctgcaggcacaaggacatggggtttggaactggggactctatttttttgtattattgtgttttgtgctactgtagttttggtgtggcacctattataattaaaataaagtacttatacc

SEQ ID NO: 2017 - DNA, 602 bp, Rattus norvegicus
  Genbank Accession No. NM_053611
gagggcagacatttggaaaacaggcaagactttggagaaagcagaccaggtatgatggccaccttgccaccaacagcccacacttcccagcaacctgtaaacatagaggacgaagatgggatcctggatgagtatgaccagtacagcctggcccaatcttatgtcgtcggtggaggtcggaaaggacgtaccaagagagaagctgctgccaacaccaaccgccccagccctggtgggcatgagaggaagctgctgaccaagttccagaactctgaaaggaaaaaggcctggcgctgagacagagctggagatgaggccagaccacggacaccacacccagcaatggatacaggaccttggagaaattaggagttgtaagcaggacctaggcctgcttgattctttcccacctaagtgaggctctggagagggaacaccaaaaaaagcccttccggacccagctaaagggcaagttaggagcgagaagcagagggtagatgggcagagctaagaaggcacccccaaaaagaacagtgggaaaaactggatgcccttgggtggcagtaacaataaactgtacaacagtgacagcaaaaaaaaaa

SEQ ID NO: 2018 - DNA, 2573 bp, Rattus norvegicus
  Genbank Accession No. NM_053618
cctcgcacactttatccgctgctaggcaaccggcctgccaagctgccaaccttgcgcctgcgtggggagtctgtcttccgcccctagctggcgccatcatgctgctgcctgtgttcaccctgaaactgcgccacaaaatcagcccccgcatggtggccatagggcgctacgacgggactcacccgtgcttggcggccgccacccaagcgggcaaggtttttattcataatcctcacatgcggagccagcattttagtacatccagagtgttccagagccctcttgagtctgatgtgtccctcctcaacattaaccagacagtcagctgcctcggcgccggagtcttgaaccctgagcttggctatgatactctcttagtggggacacagaccagtcttttggcttacgacatctacaataattcagatttgttctacagagaggtcgcggatggggcaaatgcccttgtgttggggactctgggggacattgccccgccccttgcaatcatcggtggaaattgtgctcttcagggttttgatcacgaaggaaatgacctcttttggacggttactggagacaatgttcattccttggctctgtgtgactttgacggtgatgggaagtcagagcttcttgttgggtctgaagattttgacattcgagtttttaaagaagatgagattgtggcagaaatgacagagacagagatagtcacctctctgtgtcccatgtacggcagtcggtttggttatgccctttctaatggcacagttggagtttatgacaaaacagcccggtactggagaattaaatccaaaaaccatgccatgagcatccatgcttttgacatcaattctgatggagtgtgtgaattgatcactgggtggtctaatgggaaggttgacgctcgcagtgaccggaccggagaggtcatatttaaagacaacttctcttctgccgttgctggtgtggtggagggagattaccggatggatggccacgtacagttaatctgctgctcagtggatggggaaatccgaggctacctgccaggcacagctgagatgaaggggaacctcctggacacaagtgtggagcagggcctgatccgagagctcagtcagaaaaagcagaacctgttgctagaactgcgcaactacgaggagaacaccaaggcagaactgagcagtcccctgaatgaggccgatggacagaaaggcataatcccagccaataccaagctccacacagccctctcagtcaatctggggaatgatgcacaagacgcacatgcggaattacgcatttccacttctaatgacacaatcatccgggcagtactcatttttgcagagggaatttttgcgggtgaaagccacgtggtccaccccagcactcacaacctttccagctccatccgggtaccaattacgcctcccaaagatgtccctgtggatctgcacttgaaaaccttcgtgggttacagaagcagcacccagttccatgtgtttgaactgataaggcagctgcccagatttaccatgtatgcactgacaagcccagacgcagcgagcgagcctgtcagtttcgtgaacttcatcgtagtagagcgggcacagaggatggtcacgtggctcaaccagaacttcttgttgccagaagacagtaacattcagaacgccccgtttcacgtctgtttcacgtccttacgcaacggtggccagctctacataaaaatgaaaccaagtggtgagatcacggtgaatactgatgatattgatcttgctggtgatatcatccagtcgatggcatccttttttgctattgaagaccttcaggtagaagcagatttccctgtctacttcgaggagttacggaaagtgctgttgaaggtagatgagtaccattcagtgcatcaaaagctcagcgccaacatggctgataattctaacctcatccgaagtttgctggtcagagcggaggatgctcgtctgatgagagacatgaaaacaatgaagactcgttatatggagctctatgaccttaataaagatttgctaaatggatataagattcgttgtaacaaccacactgaactgctaggaaacctgaaggcggtgaaccaagcaatccagagggcaggccgtctgcgagttggaaagccaaagaaccaggtgatcagtgcttgtcgggatgcgattcgcagtaacaacatcaacacactcttcagaatcatgcgggtggggactgctccttcctaggagacaggcgagaggaaggaagctgcgaaaggtttgtgtctagacatggaggctggcttgctcccagtcccatcttgatgaatggagattgctaaggatgaaaccatgctaacgaacacaactgaagacagagcaccccatctgaaagtctcctcgtctgacgtcagtattgatgagagagtgagactaaaagtaactatttccccatttcagagtttaacttgtttctgtacataaagttagtgtatgaatttatctcccccttgaaattgtaactgaaatttaaagtggaatatttactttttcatt

SEQ ID NO: 2019 - DNA, 4862 bp, Rattus norvegicus
  Genbank Accession No. NM_053623
gccgaggctcgcccctccttgcaaggctgctccagagctagcgggcacgcgagctcctctccgggagcttccttccccgaaaggccgggacccagtggcggactcgtggtgagcgaggcagcaccttcgatcccaggagattgacctgttcttaaaagtgaaagaagaaatctaagaaaaacgctatggcaaagagaataaaagctaagcccacttcagacaaacccggaagtccatatcgctctgtcacgcacttcgactcactagctgtcatagacatccctggagcagatactctggataaattatttgaccatgctgtagccaagtttgggaagaaggacagcctggggacccgggagatcctgagcgaagaaaatgaaatgcagccaaatggaaaggtttttaagaagttaattcttgggaattataaatggataaactatcttgaagtgaactgccgagtgaataactttggaagtggcctcactgcactgggactgaaaccaaagaacaccattgccattttctgtgagaccagggcggagtggatgattgcagcgcagacctgctttaagtacaactttccgcttgtgactttatatgctacccttggcaaagaagctgtcgttcatggattaaatgagtctgaggcttcctatctgattactagtgttgaacttctggaaagcaaactgaaggcggcattattagatatcaattgtgttaaacatatcatttatgtggataacaagactatcaatagagcggagtaccccgaggggcttgagattcacagcatgcagtcagtagaggagctgggatccaagccagaaaactcaagcattcctccaagtagaccaactccttcggacatggccattgtcatgtacaccagtggctctactggccgccccaagggagtgatgatgcaccatagcaatctgatagctgggatgacaggccagtgtgagcgcatacctggattaggaccaaaggacacatatattggctacttacctttggctcatgtgctggaactgacagcagagatctcctgctttacctacggctgtaggattggatattcgtcaccactcacactgtctgaccagtccagcaaaatcaagaagggaagcaagggtgattgtactgtactgaaacctacacttatggcggccgttccggaaatcatggatagaatttacaagaatgttatgagcaaggttcaagagatgaattatattcagaagactctatttaaaattgggtatgattataaattagagcaaatcaagaaaggatatgatgcccctctttgtaatctgatactgtttaagaaggtgaaggctcttctaggaggaaatgtccgcatgatgctgtccggcggtgccccactgtccccccagacacaccgattcatgaatgtctgcttctgctgccccattggtcagggctatgggctgacagaatcatgcggtgctggaacagttactgaagttaccgactacactactggaagagttggcgctcctcttatttgctgtgaaattaaactgaaggactggcaggaaggtggttatacagttcatgataagccaaaccccagaggtgaaattgtgattggaggccagaatatctccatgggatattttaaaaatgaagagaaaacagcagaagattattctgtggatgaaaatggacaaaggtggttttgcactggtgatattggagaattccaccctgatggatgcttacagattatcgatcgtaagaaagatctggtgaagctgcaagccggagagtacgtgtctcttgggaaagtcgaagccgcactgaagaattgtccactgatcgacaacatctgtgcttttgccaaaagtgaccagtcttatgtgatcagttttgtggttcccaaccagaaaaagttgactcttttggcacaacagaagggggtagaaggatcttgggttgatatttgcaataatcctgccatggaagctgaaatactgaaagaaattcgagaagctgcaaatgccatgaaattggaacgatttgaaattccaatcaaagttcgattgagcccagagccatggacccctgaaactggtttggtaacagatgccttcaagctgaaaaggaaggaactgaagaaccattatcttaaagacattgagcggatgtatgggggcaaataaaaggcaactgtctacttcacatttgcacaggaggtggcctgatggtttttttagttctagagtttaagcctttgttgatctctctgttaaaatgtaaggtgaatcttctaaagacatgaaacaaaaaaacaaccaaaagtggttacaataaattgcatagtcctagagaagctgaaattgaagacatttccctttagctgtgttattaagtttagagcaaaaattctgttttagaatattagccttagctacacttgtttttctaaagatactccatgctaaagtaaacaaattggacttggactaggtgtagttgaagaaatctacagcttccagtgtctatgtcttcctagttcagaagtttctatcgtaatcattaggacaaaattacgtattaacactactcaaagccgaagttccaccaggctttgaaatcctcttccaaccatttctcttgaagggaaaaaaatcagttgtaataaatggattcagtatcttagaaggtattattttaagctcataattgccatgtaggtgagacatagaatcattataatattgtgaataattacagtgcctgaagttaaaactaaaacaacacacacataccaaaaatatctcataatgtatttgaagggaggctgaattgctcctttggatgtctaagaacttaaatcagcaactgtaattattgaaatgtcttcagaaaaatgtccactttgtaaaagtgacctttctgtgtgtgatctagtcaaaggctgagaccaaggggaacatgttagaaagtcaatcagaattcaataagatacattgcttttctgttagaaagttcatggcatcctaagcattcagaattaggatcctggcatagcactgagcctgggaaagagatttagcctctttaactttgataccagggcttgattttaaaatgtgcttgtattaaattacatttgtaatttatggtctgtttgctgttgctgattgattcttgatcagtagtgtgcatttcagagagcctttcattttgctttaatttcagcaaagcgggttatgataaatgacttcctcgaatcttgttcaaacctacgggtgattaagtgtcttggatgagtctgaggaagttaaagggaagaaaacactgttaacacttttcctgtttgtgaagagtttagaaactggaaatgctagatttgggagaagggcagagttacttgattaaggactgtctgtgcagtaacttgggagtgtgagtttctttttaaatcttcagctaaaatctggaattatatattcttgatagatattcgcacttgaaccatagttactgtatgtaaaaagcaaaaattcttaatactgttattctttgcacttttttcatagtcattttatacacacacacacacacatgcatgtgtatgtgtgtgtgtatatataatatatatatgttgcttacattgtgttgtacagatgtgggccaccactacaacaaaatgagttctttgtgctctaaaatatttataaagaaattatttaaatgttatgtatatggtggtaatattgagaaaaaaaatcatctggtattctgagcaacagcgaaggtttttgtaaaagtttcttttcagtgttgtgcaaactaaaatttgaggcaagttttccctgaagttctatgtgagtattctcatgcttcccatcttgcctttgaagtgtgaaaagacatcaagtagactactagtcagcttctacctactcctagtgcactgtttatccgtttttttttaaaggcttttccaatatatgtatcccatttggaatggtgattttaaaatgtgagtgcatgcagactatcttacttaagatacttgcaccccacccacagccatctcccaaagctggaacactgccaactaggtccttaagaatcacgcattgaatacaaggtcgggtgctgctaattcttcatgaaaatcctaacacacacgttaagggaccagggagatgccactgccctctgacttttcatcaaaaaaaaaatatatatatacatgtttatgtaaacagaactattttccatattcatagtgactttttaagtatttgagcctaaaggttttgatctccattttatacctatttaaatcgttcacaatttcatgtcagccatcaattaaagctgtgcttactgttgattgtgtgtgcatttctaaggtgaacgctcctaattttttgctttaattacatgaaagggtcttatttctttgatatttgtgctcttttttttaatgtagactgaaggtatgattgtgtgacttttaagaaatgaaataccgatgaatgatccatagagtccaaagtgagggagaatgctgtttctttgttcatagagactgactagtaatctttgcctatattttcctggtagcagatgacaaatgtttctacagtgacaagctgagaagaggttaaaggttaaagattgtgtggcattcgggaactggagagatacgttttaattttgaatgtagttacaaattttatattcatatttgtactttctgttaatgcacgattgtagaattgttctgtagattttttgtgtttactcttgaaaggctttgtttgttcttctttttaagtttgcacttgaatcttataaaataaatc

SEQ ID NO: 2020 - DNA, 1646 bp, Rattus norvegicus
  Genbank Accession No. NM_053626
caacgcagcccagaatcaggagcaatcctgctggagacaggttcctgcacccccaggccatttttctctagacacttggcaccagcggctggggtgatgcgcgtggccgtgattggagcgggagtcatcggactgtctacagccctctgcattcatgaacgttaccacccagcccaacctctgcacatgaagatctatgcggatcgcttcacgccgttcactaccagcgatgtggctgcgggactctggcagccttatctctctgaccccagcaacccgcaggaggcggagtggaaccagcaaactttcgatcaccttcagagctgcctccattctccaaacgctgagaaaatgggcttggccctaatctcaggctacaacctcttccgagacgaagtcccggaccctttctggaaaagcacagttctgggattccggaagctgacccccagcgagttggacatgttccctgattatagctatggctggttcaacacgagcctccttcttgaggggaagagctacctatcatggctgactgagaggttaactgagaggggagtgaagttcatccatcggaaggtggcatctttcgaagaggtggtgagaggaggcgtggatgtgattatcaactgcaccggggtgtgggccggggctctgcaagcagacgcctccctgcagccaggccggggccagatcatccaggtggaggccccttggataaagcacttcatcctcacccatgatcccagccttggcatctacaactctccatacatcatcccaggttccaagacagttacactcggaggtgtattccagctggggaactggagcgagctaaacagcgtccatgaccacaacaccatttggaagagctgctgtcaactggagcccaccctgaagaatgcaagaatcatgggtgaactcactggcttccggccagtccgacctcaggtccggctagaaagagaacgccttcgctttggatcttcaagtgcagaggtcatccataactatggtcatggaggttacgggctcacgattcactggggttgtgcaatggaggcagccaacctctttgggaaaattctagaagaaaagaacttgtccaggatgcctccatcccacctctgaggactctggtgaataccacttgccccaagacgacatcccaaccccttcagccagttgacaccatccttgatgattccctcccccagccccagcccctcctccagcacccccttggcaaaggcctgaagggaggaaatcctgctgttccctctctgcctagtccttccagggcagtgatgctggttggttctaaccaaggctgcatgagacaggcgagatctacaaccatgatgcaattcttctcacgctgcaacgactgtactaaggctggtcctactgggtggcagggtctgtgttcagtctgatagagtagtctggaatcttttgcttagaactctgatgaacggttcacgacactatccatgtctatttgtagtgatggagtgatgggaggagagggaggaagaagaggaggagggggagggggaggagggggaggagggggaggaggaggagggctccctcttcagcactctgctggtcaacatcattaaagcactgaatatcca

SEQ ID NO: 2021 - DNA, 2207 bp, Rattus norvegicus
  Genbank Accession No. NM_053648
cattttagaggcactatttctagtacaatgggtatgaagctgtgatttgagccgcaaatttcagagcattggccatagaacagacctggtcggtttgatgtcactgtagcttggtttaggcggccggggattgcgtcggtttttaaccctagtgaagggacggctcatgagtgcaggacgtcttcggatgagattagtatacgaattggaagttctattggtaagactacccgattatcaacttctaatagacgaagctcacctggttttaggtcgggacagatggaggcatcaaggagcagagggcaggaagacaggacgctttgagcacacggggctttgtgtctattccactgacaacctcctcactgccacccaccggttccatggagataatatttggccggaataagaaagaacagctggagccattacgggccacagtgacaggcagcattccagcatggctgcaggggaccctgctccgaaacgggcctgggatgcacacagtgggagacagcaagtacaaccattggtttgatggcctggcccttctccacagtttctccatcagagatggggaggtcttctacaggagcaaatacctgcagagcgacacctacaacgccaacatcgaggccaatagaatcgtggtgtctgagttcggaacaatggcctacccagacccctgcaaaaacatcttttccaaagctttctcctacttgtcccacaccatccccgacttcacagacaactgcctgattaacatcatgaaatgtggagaagacttctatgccaccacagagaccaactacatcaggaaaatcgacccccagactctagagaccttggagaaggttgattaccggaagtatgtggctgtaaacctggctacctcacaccctcattacgacgaggctggaaatgtccttaacatgggtacctccatcgcggacaaaggagggacaaaatacgtgatgtttaagatccccgccacagcaccaggcagcaagaagaaagggaagaaccccttgaagcactcagaagttttctgctccatcccgtcccgctcgctgctctcccccagttactaccacagctttggagtcacggagaactatgtggtgtttctggagcagccttttaagctggatatcctcaagatggccaccgcatacatgaggggtgtgagctgggcttcctgtatgacattctgcaaggaggacaagacttacattcatatcatcgaccagaagaccagaaagcctgtgccaaccaaattctacacagaccccatggtggtcttccaccatgttaatgcctatgaggaggacggctgtgtgctgtttgatgtcatcgcctatgaggacaacagtctctatcagctcttctacctggccaacctgaacaaggacttcgaggagaagtccaggctgacctcagtgcctaccctcaggaggtttgctgtgcccctccacgtggacaaggatgcagaagtgggctcgaatttagtcaaggtgtcatctacaacagcaactgccctgaaggagaaggacgaccatgtctactgccagcctgaggtcctctacgaaggcctagagctccctcggataaattatgctcacaacgggaagccatatcgctacatctttgctgctgaagtacaatggagtccagtcccaaccaagatactaaaatatgacgttctcaccaagtcctccttaaagtggtccgaggagagctgctggcctgcagagcctctgtttgtccccacaccgggtgcgaaggatgaggatgatggagtcatcttatcagccatcatctctacagatccccaaaagctgccctttttacttattctggatgcgaaaagttttacggaattggctcgcgcctctgttgatgtggacatgcacctggacctgcatggtttatttattccggatgcaggctggaatgcagtgaagcagactccagccaaaacgcaagaggatgaaaattcagatcatcccacaggtctgacagcaccaggattgggccatggtgaaaatgacttcacggcaggtcatggcggcaagagcctttaatcctagcactcgaggcagaggcaagcagatctctgagttcaaggccagcctggtctacaacacaagttccaggacagccagggatacacagagaaatcctatcttgaaaacaaagcaaag

SEQ ID NO: 2022 - DNA, 1596 bp, Rattus norvegicus
  Genbank Accession No. NM_053653
gggactgggacgaggagcggacctcagcctcgcaccccagcctgcgcctgccatcggaccggcctcctcgctcccggtccatccaccatgcacttgctgtgcttcttgtctctggcgtgttccttgctcgccgctgcgctgatccccggtccgcgcgaggcgcccgccaccgtcgccgccttcgagtcgggactgggcttctcggaagcagagccggacgggggcgaggtcaagggtttcgaaggcaaagacctggaggagcagttgcggtctgtgtccagtgtagatgagctcatgtctgtcctgtacccagactactggaaaatgtacaagtgccagctaaggaaaggcggctggcagcagccctccctcaacatgaggacaggggacactgtaaaacttgctgctgcacattacaacactgagatcctgaaaagtattgataatgagtggagaaagactcaatgcatgccacgtgaggtgtgtatagatgtggggaaggagtttggagcagccacaaacaccttctttaaacctccatgtgtgtccgtctacagatgtgggggttgctgcaacagtgaagggctgcaatgcatgaacaccagcacaggttacctcagcaagacgttgtttgaaattacagtgcctctctctcaaggccccaaaccagtcacaatcagttttgccaatcacacttcctgccggtgcatgtctaaactggatgtttacagacaagttcattcaattattagacgttctctgccagcaacattaccacagtgtcaggcagctaacaagacttgtccagcaaactacgtgtggaataactacatgtgtcaatgcctggctcagcaggattttatcttttattcaaatgttgaggatgactcatccaatggattccatgatgtctgtggacccaacaaggagttggatgaagacacctgccagtgtgtctgcaagggggggcttcgaccatccagctgtggaccccacaaagagctagatagagactcatgccagtgtgtctgtaaaaacaaacttttccttaattcatgtggagccaacagggaatttgatgagaacacatgccagtgtgtctgcaagagaacatgtccaagaaatcaacccctgaatcctggaaaatgtgcctgtgaatgtacagaaaacacacagaagtgcttcctaaaagggaagaaattccaccatcaaacatgcagctgttacagacgaccatgtacaaatcgactgaagcattgtgatccgggactgtcatttagtgaagaggtgtgtcgctgtgtcccatcatattggaaaagaccacatctgaactaagatcataccagtttttcagtccatcattttgctgccttgaaaaactgttgccacattagaactgtcaatgcacagaaagactctgtgggaccatggtaacagggtccaagtctctgtctcctgaaccatgtggattactgtgggaatggactggcattcatgtgcataaagccttttaagagactggttttctgccagtgaccagacagctgaggtttttctcttgtgattttgaaaaaaaaaaaaaaaaaaaaaaaaaaa

SEQ ID NO: 2023 - DNA, 2092 bp, Rattus norvegicus
  Genbank Accession No. NM_053662
agtctcgctttgggttccggctgcgtcgggcgtgcgtgtagctcgctagaactatggcgtccgggcctcacccgacatcgaccgctgccgccgcctctgcctcgtccgccgccccgagtgcgggcggctccagctccggcacgacgaccacgacgacgacgacgaccggagggatcctgattggcgaccgcctgtactcggaggtgtcgcttaccatcgaccactcggtgattccggaggagcggctctcgcctaccccgtccatgcaggacggcctcgacctgcccagcgagacggacctgcgcatcttaggctgcgagctcatccaggccgccggcattctcctccggctgccgcaggtggcgatggctacggggcaggtgttgtttcatcgttttttctactccaagtctttcgtcaaacacagtttcgagattgttgccatggcctgtattaatcttgcatcaaaaattgaagaagcaccaagaagaataagagatgtgattaatgtattccaccacctccgccagttaagaggaaaaaggactccaagccccctgatccttgatcagaactacattaacaccaaaaatcaagttatcaaggcagagaggagggtgctaaaggagttgggattttgtgttcatgtcaagcatccccataagatcattgtaatgtatttacaagtcttagaatgtgaacgtaaccaaaccctggttcagactgcctggaattatatgaatgacagtcttcgaaccaatgtttttgttcgctttcaaccagagactatagcatgtgcttgtatctaccttgcagctagagcacttcaaattccattgccaactcggccccattggtttcttctttttggtaccacagaagaggagattcaagaaatctgcatagagacacttagactttataccaggaaaaagcctaactatgaattgctggaaaaggaagtagaaaaaagaaaagtagccttacaggaagccaagttaaaggcaaagggattgaatcttgatggaactccagccctttccactttaggtggtttttctccagcctccaaaccatcatcaccaagagaagtaaaagctgaagagaaatcaccagtttccattaatgtgaagacagtcaaaaaagaacctgaggatagacaacaagcttccaaaagcccttataatggtgtaagaaaagacagcaagagaagcagaaacagcagaagtgccagtagatcaaggtcaagaaccaggtcacgctctagatcacacaccccaagaagacattataataataggcgaagtcgatctggaacatacagctcaagatcaagaagcaggtctcgcagtcacagtgaaagtcctcgaagacatcataatcatggttctcctcaccttaaggccaaacataccagagaagatttaaaaagctcaaatagacatggtcataaaaggaaaaaatctcggtctcgatctcagagcaagactcgggatcactcagatgttaccaagaaacacaggcatgaaagggggcatcacagagacaggcgtgaaagatctcgctcctttgagaggtcccataaaggcaagcaccacggtggaagtcgctcaggacatggcaggcataggcgctgactttcatcctctgacactgcatcggtccctggtgttgcccatatgcagtgtgacgatgtatggactcaatcaaaacatgaaaagcaaactgattagggattgatttattaaaattgtctaggtttctagaaacactgaggacattttcttttgaaaagaactatgttaaggttttttgcacattaaaatgccctagcagtatctaattgaaaaccatggtcaggttcaattgtactttattatagttgtgtattgtttattgctataagaactggagcgtaaattctgtaaaaatgtatcttatttttatacagataaaacttgcagacactgttctatttaagtggttatttgtttaaatgatggtgaatactttcttaacactggtttgtccgcatgtgtaaagatttttacaaggaaataaaatacaaatcttgtttttctaaaaaaaaaaa

SEQ ID NO: 2024 - DNA, 1155 bp, Rattus norvegicus
  Genbank Accession No. NM_053698
cacgagggttggcagctgcctggcggtcctgaggagcggctagggcagcggagggaaagaaaagggaacggctcggaatttgctccagcggctgctgcaagacctcggcgccaacctcgcaccagcgagcgccccacagcccttcggctgcccctctatgtgctgctgagccggtcctggacccgacgagcccgccttcggtgttccgagccgaaatcgcaaagacggaaggactggaaatggcagaccatatgatggccatgaaccacggtcgcttccccgacggcaccaacgggctgcaccaccaccctgcccaccgcatgggcatggggcagttcccgagcccgcatcaccaccagcagcagcagccccagcacgccttcaacgccctcatgggcgagcacatacactacggcgcgggcaacatgaatgccacgagcggcatcaggcacgccatggggccggggactgtgaacggggggcaccccccgagcgctctggccccggccgccaggtttaacaactcccagttcatgggtccccctgtggccagccagggaggctccctgccggccagcatgcagctgcagaagctcaacaaccagtatttcaaccatcacccctacccccacaaccactacatgccggatttgcaccccgctgcaggccaccagatgaacgggacaaaccagcacttccgagattgcaaccccaagcacagtggaggcagcagcacccctggcggcgcgggtggcagcggcacccccggcggctccggcggcacctcgggcggcgcgggtggcagcagcgcgggcggcagtggcggtggcagcaccatgcccgcctcggtggctcacgtccccgcggcaatgctgccgcccaatgtcatagacactgatttcatcgacgaggaagtgcttatgtccttagtgatagagatgggtttggaccgcatcaaggagctgccagaactctggctgggccaaaatgagtttgattttatgacggacttcgtgtgcaaacagcagcccagcagagtcagctgttgactcggttaacctcgcggctgaaagaaatcaccctccctgcccccacccccaacttcttcggtgtgaattaaaaaaaatcaaaaacaaacaaaaaaaaaacaaaaaa

SEQ ID NO: 2025 - DNA, 2393 bp, Rattus norvegicus
  Genbank Accession No. NM_053713
atcttcgttgacttcggggtttgggtacccctctctcttcttcggactccggaggaccttctgggcccccacattaatgaggcagccacctggcgagtctgacatggctgtcagcgacgctctgctcccgtccttctccacgttcgcgtccggcccggcgggaagggagaagacactgcgtccagcaggtgccccgactaaccgttggcgagaggaactctctcacatgaagcgacttcccccacttcccggccgcccctacgacctggcggcgacggtggccacagacctggaaagtggtggagctggtgcagcttgcagcagtaacaacccggccctaccccggagggagaccgaggagttcaacgatctcctggacctagactttatcctttccaactcgctatcccaccaggaatcggtggccgccaccgtgaccacctcggcgtcagcttcatcctcgtcttccccagctagcagcggccctgccagcgcgccctccacctgcagcttcagctatccgatccgggccgggggtgacccgggcgtggctgcgggcaacacaggtggagggctcctctacagccgagaatctgcgccacctcccacggcccccttcaacctggcggacatcaatgacgtgagcccctcgggcggcttcgtggctgagctcctgcggccggagttggacccagtatacattccgccacagcagcctcagccgccaggtggcgggctgatgggcaagtttgtgctgaaggcgtctctgagcacccctggcagcgagtacaccagcccttcggtcatcagtgttagcaaaggaagcccagacggcagccaccctgtggtagtggcgccctacagcggtggcccgccgcgtatgtgccccaagattaagcaagaggccgtcccgtcctgcacggtcagccggtccctagaggcccacttgagcgctggaccccagctcagcaacggccacaggcccaacacacacgacttccccctggggcggcagctccccaccaggactacccctacactgagtcccgaggaactgctgaacagcagggactgtcaccctggcctgcctcttcccccaggattccatccccatccggggcccagctaccctcctttcctgccagaccagatgcagtcgcaagtcccctctctccattatcaagagctcatgccaccgggatcctgcctgccagaggagcccaagccaaagaggggaagaaggtcttggccccggaaaagaacagccacccacacttgtgactatgcaggctgtggcaaaacctatacgaagagttctcatctcaaggcacacctgcgaactcacacaggcgagaaaccttaccactgtgactgggacggctgtgggtggaaattcgcccgctcagatgaactgaccaggcactaccgcaaacacaccgggcaccggccctttcagtgccagaagtgcgacagggccttttccaggtcggaccaccttgccttacacatgaagaggcacttttaaattccacatcgtggacatgacccacactgccaggagagagttcagtatttttttttaacctttcacactgtcttcccacgaggggaggagcccagctggcaagcgctacaatcatggtcaagttcccagcaagtcagcttgtgaatggataatcaggagaaaggaagagtccaagggacaaaagaaaagaaaagaaaaaaatactaaaaaacaaacaaacaaaaaaaaaaaacaaaagaaaaaaatcacagaacagatggggtctgagactggatcttctatcattccaataccaaatccgacttgaacaagactggacttacaaaatgccaaggggtgactggaagtttgtggatatcagggtatacattaaatcagtgacctggggggagggaagaccagagttcccttgaattgtgcttcaatgatgcaatatacatggaaagaccaccttgtatgctctttgccttctaaaaagccattatgacgtcagaggaagaggaagcaattcaggtacagaacgtgttctaatagcctaaacgatggtgcttggtgagtcgtggttctaaaggtaccaaacgggggagccaaagttctccaactgctgcatactttgacaaggaaaatctatttttgtcttccgatctacatttatgacctaagtcaggtaaataagcctggtttatttctgtaacattttttatgcagacagtctgttatgcactgtggtttcagatgtgcaataatttgtacaatggtttattcccaagtatgcctttaagcagaacaaatgtgtttttctatatagttccttgccttaataaatatgtaatataaatttaaaaaaaaaaaaaaaaaaaaaaaaaaa

SEQ ID NO: 2026 - DNA, 2131 bp, Rattus norvegicus
  Genbank Accession No. NM_053747
gtgtcgcgctcgcctgagtcaccgccatggccgagagcgcagagagcggcggcccaccgggcgctcaggacagtgcggccgacagcggccccgcagagcccaagatcatgaaggtcacggtgaagacgcctaaagagaaggaagagttcgctgtgcccgagaacagctcggtccagcagttcaaagaggaaatctcaaaacgtttcaaatctcatattgaccaacttgtgttgatatttgctggaaaaattttaaaagatcaagatactttgagtcagcatgggattcatgatggacttacggttcaccttgtcatcaaaacccaaaacaggccgcaagataattcagctcagcaaacaaataccactggaaacagtgtgaccagttcaccagctcctgacagtaaccccacgtctgggcctgctgctaacagctcctttggtttaggtggacttggaggacttgcaggtcttagtagcttgggtttaaataccaccaacttctctgaactacagagccaaatgcagcggcaacttttgtctaaccctgaaatgatggtccagatcatggaaaacccctttgtgcagagcatgctctcaaaccctgacctgatgcggcagctgatcatggccaacccacagatgcagcagctgatacagagaaacccagagatcagtcacatgctcaataacccaaacataatgcgacagacattggaacttgccagaaacccagcgatgatgcaggaaatgatgagaaaccaggaacgagacttgagcaacctagaaagtatccctgggggctacaacgccttacggcgcatgtacacagatattcaggagcccatgctaaacgctgcgcaagagcagtttggtggtaatccatttgcttccttagtgagcagtccgtcctcagcagaagggactcagccttctcgaacagaaaatagggatccgctacctaacccttgggctccacagactccccagagctctccagcctctggcagcactggcagcaccactaacacagtgagcacctctgctggcaatgccaccagtaccccggcgggacagggcacctcagggcccaacttggtgcctggagcaggagctagtatgttcaacacgccagggatgcaaagcttgttgcagcaaataactgagaaccctcagctcatgcagaacatgctgtctgccccctacatgagaagcatgatgcagtcactgagccagaaccccgaccttgccgcacagatgatgctgaataaccccctatttgctgggaaccctcagcttcaagagcaaatgagacaacagctcccaaccttcctccaacaaatgcagaaccccgacacactgtcagccatgtcgaaccctagagccatgcaggcgctgctgcaaatccagcagggcttgcagacgttggccacagaagctcccggcctcatcccagggtttactcctggcttggcagcgggcaattctggaggccctgcaggaaccactgcacctagcactgcacctggtgaggatacgaacccccaagggggcgctgctgagccaggccaccagcagtttatccagcaaatgctgcaggccctcgccggggtgaaccctcagctgcagagtccagaagtcagatttcaacagcaactggaacagctcagtgcaatgggattcttgaaccgtgaagcaaacttacaagcactgatagcaacagggggcgacatcaatgcggccattgaaaggttgctgggttcccagccgtcatagcagcatttctgtatcctgaaaaaatgtaatttatttttgataacggctcttaaatctttaaaataacctgctttatttcattgggattctgtgctgttgtaaaggaaaccaataggaagtctctggaggtggagtgcagtaagatgtgcgggtttctgtgtctttggaacagtgggaatcgatgtctctggttaaggccgctgcatgcgtcaaacacttggcatttgttgtaatcttttaaacatcaccttttctaattgggtgaacacatttttgtcctgcatctgtccaactaacttgctttttaaacatagccctctggtagtaatttatgtagaataaaggcattaaaaagc

SEQ ID NO: 2027 - DNA, 2632 bp, Rattus norvegicus
  Genbank Accession No. NM_053748
ctgcagcagggctcatggcagatacccagtacatcctgcccaatgacatcggtgtgtctagcctggactgccgggaggcattccgcctgctgtcacccacagagcgcctctatgcccatcacctgtctagagccgcttggtatggaggcctggctgtgctgctccagacatctcctgaagccccctacatctatgccctgcttagccgcctcttccgtgcccaggaccctgaccagctacgccaacatgccctggctgagggcctgactgaagaagagtatcaggcattcctggtctacgctgcaggggtctactccaacatgggcaactataagtccttcggtgacaccaagtttgtccctaacctgcccaaggaaaagctggagcgtgtgatccttgggagtaaggctgcccaacagcatccagaagaagtcaggagcctttggcagacctgtggggagcttatgttctccctggaaccaaggcttcgacatcttgggctggggaaggagggagtcaccacctatttctctggggattgtgccatggaagatgccaagctggcccaggacttcctggactctcagaacctcagtgcatacaacacccggctcttcaaggtggtcggccaggaagggaagtaccactatgaggtgcgactggcttcagtactcaacacagaacctgctctcgactctgagttgacttccaagctgaagagctacgagttccaggggaatcatttccaggtcacccgtggggactatgcccccatcctccagaaggtggtagaacacttggagaaagctaaggcttatgcagccaatagccaccaggagcaaatgctggcccagtatgtggagagcttcacccagggttccattgaggcccataagaggggctcccgcttctggattcaggacaaaggtcccattgtagagagttacattggcttcattgagagctaccgtgacccctttggctcccgaggagaatttgaaggcttcgtggccatggtaaacaaagacatgagtgcaaagttcgagcggctggttgcaagtgctgagcagctgctgaaggagctgccttggcctcctgcctttgagaaggacaagttcctcacccctgacttcacttccctggatgtccttacctttgccggctctggcatccctgcaggcatcaacatccccaactatgatgacctgagacagacagagggctttaagaatgtgtctctggggaatgtgctggctgtggcctatgccacaaagcgggagaaactcaccttcatggaggaagaagacaaggacctgtacatccgctggaaggggccgtcctttgatgtgcaggtggggttacatgagctgttgggccatggcagcggcaagctctttgtacaggatgagaaaggtgctttcaactttgaccaggagacagtgatcaacccagagactggggagcagatccagagctggtaccggagtggagagacatgggatagcaaatttagcaccattgcctccagctacgaagagtgccgggctgagagcgtgggcctctacctctgtctcaacccccaagtacttcagatctttggctttgagggaactgacgcagaagatgtcatctatgtgaactggctcaacatggtccgggctgggctgttggctttggagttctacaccccagagacggccaactggcgacaggcccacatgcaggcccggtttgtgatcctgagggttttgctggaagctggcgaaggactcgttaccgtcacccccaccacaggctctgatgggcgcccagatgctcgtgtccacctggaccgcagcaagatccggtcagtgggcaaacctgctttggagcggttcctccggagactgcaggtgctgaagtccacaggggatgtggttgcagggcgcgccctgtacgagggctatgcggcggtcactgacgcacccccagagtgcttcctcactctaagggacacggtattgctgcgcaaggaatcccggaagcttattgtccagcccaacactcgcctggaaggctcagaagtgcaacttgtagagtatgaggcctcagcggctggtctcatccgatccttctgtgaacggtttccggaggatgggcctgagttggaggaggttcttacccagctggccacagcagatgctcaattctggagggatcaggtccaggaggccccatctggccaggcttgagaagatctgtgtggcatctcccctttcatcaaaccagggctgtctgtggccctgaattgtgtttaggaggtgggggaagggcaggagctcggactttggtgctacctcagctgagggtggtgatgctaaccccttccatttgtcagcactttccagtttaccattatgtcctcatttcctggatctgcactgccatctgtggtgggagctcaacagggtgcctagtctggttttccaaatgggaaggtggcagttctgagaagtaactgttctagatccagcaggtggcatgtgacagagccagggctcaaagcattctcaccaaatccagtgctcttcgtgtattaccttttatagccagaaaaataaatatgacaaccaccaaaaaaaaaaaaaaaaaa

SEQ ID NO: 2028 - DNA, 2426 bp, Rattus norvegicus
  Genbank Accession No. NM_053763
gagcagactcctcaaacacaaacatgacccaggcagtcaagctcgcctccagagtcttccatcgagtccaactgccttctcagctgggcagtgactcggttctccggagtttatctgatatccctgggccctctacacctagcttcctggctgaactcttctgcaaaggggggctgtccaggctacatgaactgcaggtgcatggcgctgcgcggtacgggccaatatggtccggcagcttcgggacacttcgcacagtttatgtggccgaccctgcacttgtagagcagctcctgcgacaagaaagtcattgtccagagcgctgtagtttctcatcttggtcagagcaccgtcgccgccaccagcgggcttgcgggttgctaacggcggatggtgaagaatggcagaggctccgaagtctcctggccccgctactcctccgacctcaagcagccgccggctatgctggaactctggacagcgtggtcagtgacctcgtgcgacgactaaggcgccagcggggacgtggctctgggctaccggacctagttctggacgtggcgggagagttttacaaatttggcctagaaggcataggcgcggtgctgctgggatcgcgcctgggctgcctggaggctgaagttcctcccgacacagaaaccttcattgaggccgtgggctcggtgtttgtgtctacactcttgaccatggcaatgcccagttggctgcaccgccttatacccggaccctgggcccgcctctgcagagactgggatcagatgtttgcctttgcccagaagcacgtggagcagcgcgaaggcgaagctgccgtgaggaaccagggaaagcctgaggaggatttgccaacggggcatcacttaacccacttcctttttcgggaaaaggtgtctgtccagtccatagtgggaaatgtgacagagctactactggctggagtggacacggtatccaatacgctctcctgggcactctatgagctctcccggcacccggaagtccagtctgcactccactctgagatcacaggcgctgtgaaccctggctcctatgcccacctccaagccactgctctgtcccagctacccctgctaaaggctgtgatcaaagaagtgttgagattgtaccctgtggtacctgggaactcccgtgtcccagacagagacatctgtgtaggaaactatgttattccccaagatacactggtttccctctgtcactatgccacttcaagggaccccgcccagtttcgggaacccaactcttttaatccagctcgatggcttggagagggtccagccccccacccatttgcatctcttccttttggctttggcaaacgaagttgcatagggagacgcttggcagagctcgagctacaaatggcgttggcccagatcttgacccattttgaggtgctgcctgagccaggtgctcttccagtcaaacccatgacccggactgtcctggtacctgagaggagcatccatctccagtttgtagacagatagtcctgtggaaggcagctgtcatcatctctctccagactggatttttcttactatgcacaagaggcacactctccctcgaggcctgtctgtctgagcaaacttcaggaagcaggcccgggcctatctgtgcttgacctgactcagcaggtaccacagaaccaggatcctttctcctgctcagtacctctcctgatcattcctcaagatccaaagccttcagattttaacacatccttaaagggccaactcgggggttaactaacagccccaggcagcctgggcagggatcccccactgatccttccatgcttacagtgttcactgacagctgtctaagcatccattgcagcacaaactaagtgactgtgcacctggtctgcacctggtctgcacctggttgcgtctctgcctgaccatgtgagctctttgagaagagtgatgactactgggcttttagctcttttcctttttgggacacagtcttgctattgtactccatgctgtccttgaacccacaagccctcacctcaccttcccaagtgttgggttacggacattagctatggcttccagctttattagtctttctatctcctgccatggtctatccccggctatttgatactatatattctcagattgaatctggaccatgtggtagaagggatgaccactcaccaggctctacccaccactttatcttaatcttttctctaggaaagtgaatctctccttgccttacagcattttaaagctccccttggctgttctgctctttagccactctaaagtggatccactctacttctcaccacccatctttctgcaccccagcctgtctttttatatttaaaaaattgtatttattatgttttcaaataaaatgtttactccttg

SEQ ID NO: 2029 - DNA, 1104 bp, Rattus norvegicus
  Genbank Accession No. NM_053769
atggtgatggaggtgggcatcctggacgccggggggctgcgcgcgctgctgcgagagcgcgccgctcagtgcctgcttctggattgtcgctccttcttcgccttcaacgccggccacatcgtgggctcagtgaacgtgcgcttcagcaccatcgtgcggcgccgcgccaagggcgccatgggcctggagcatatcgtgccgaacaccgaactgcgcggccgcctgctggccggagcctatacgcccgtagtgctgctggacgaacgcagcgccgccctggacggccgcaagcgcgacggcaccctggccctggccgcgggcgcgctctgccgagaagcgcgctccactcaagtcttcttcctccaaggaggatatgaagcgttttcggcttcctgccctgagctgtgcagcaaacagtccacccccatggggctcagcctcccgctgagtactagtgtgcctgacagtgcagaatccggatgcagctcctgtagcacccctctctacgaccaggggggcccagtggagatcctgtccttcctgtacctgggcagtgcttaccatgcttcccggaaagatatgctcgacgccttgggtatcactgctttgatcaacgtctcggccaattgtcctaaccactttgagggtcactaccagtacaagagcatccctgtggaggacaaccacaaggcagacattagctcctggttcaacgaggcgattgactttatagactccatcaaggatgctggaggaagggtgtttgtgcactgccaggccggcatctccaggtcagccaccatctgccttgcttacctcatgaggactaaccgagtgaagctggacgaggcctttgagttcgtgaagcagaggcggagtattatctcccccaacttcagcttcatgggccagctgctgcaatttgagtcccaagtactggcccctcactgttctgcagaagctgggagcccggccatggctgtccttgaccggggcacctctactacaacggtcttcaacttccctgtctccatccctgttcaccccacgaacagtgccctgaactaccttcaaagccccatcacaacctctccgagctgctga

SEQ ID NO: 2030 - DNA, 1857 bp, Rattus norvegicus
  Genbank Accession No. NM_053774
atgtcccagctctcctccaccctgaagcgctatacagaatcgtcccgctacacagatgccccttatgccaaatcgggctatggcacctacaccccttcttcctatggggccaacctggccgcctccttcctggagaaggaaaaacttggtttcaagccggtctcccccaccagcttcctcccacggccccgcacctacggcccctcctccatcctggactgtgacaggggccgccccctgctgagatctgacatcactgggggtagtaagcggtctgagagccagacccgtggcaatgaaaggccctcaggcagtggactcaacggaggcagtggatttccttatggagtgaccagcaactccctcagctacctgcccatgaatgccagagaccagggcgtgaccctgggccagaagaaatcgaacagccaatcagacctggcccgggatttctccagcctccggacctcagatagctacaggacttcagatggctaccgggcctcagatggctctaggatagaccccggaaacctgggtcgcagccccatgctggcccgcacacgtaaggagctctgtgccctgcagggcctctaccaagcagccagccgttctgagtacctaacagactatctggagaactatggccgcaagggcagtgcaccacaggtgctcacacaggcccctccctcccgagtccccgaagtcctcagtcccacctaccgaccaagtggccgctacacactgtgggagaagaacaagggccaggcttctggggccagccgctccacttctccagggcgagacaccatgaattcaaagagtgcccagggtctggctggtcttcgaaaccttgggaacacgtgcttcatgaactcaattcttcagtgtctgagcaacacccgcgagttgagagattactgcctccagaggctgtacatgcgggacctcggccataccagcagtgcacacacagctctcatggaagagtttgcaaaactaatccagaccatatggacgtcatcccccaatgatgtggtgagcccatctgagttcaagacccagatccagagatatgcaccacgcttcgttggctataatcagcaggatgcccaggaattcctccgtttccttctggatggcctccacaacgaggtgaaccgggtggcagcaaggcctaagcccagccctgagagccttgatcatctccctgatgaagagaaagggcgacagatgtggaggaagtatctagaaagggaagacagtcggattggggatctcttcgtcgggcagctaaagagctccctgacgtgcaccgactgcggctactgctctacagtgttcgatcccttctgggacctctcgttgcccattgcaaagagaggctatcctgaagtgacgttaatggattgtatgaggctcttcaccaaagaggatgtgttggatggggatgagaaaccaacatgctgccgctgccgggccagaaaacgatgtataaagaagttctctgtccagaggttcccaaagatcttggtgctccacctgaagcggttctcagaatccaggatacgaaccagcaagctcacaacatttgtgaatttcccactaagagacctggacttgagagaatttgcttcagaaaacaccaaccatgctgtttacaacctgtatgctgtgtccaatcactccggaaccaccatgggaggtcactatacagcctactgccgaagtccggttacgggcgaatggcacactttcaatgactccagtgtcacacccatgtcctccagccaagtgcgcaccagcgacgcctatttgctcttctatgaactggccagtccaccctcccgtatgtag

SEQ ID NO: 2031 - DNA, 2243 bp, Rattus norvegicus
  Genbank Accession No. NM_053806
atgcggcggggcgcgctcctggctagcgccctggtcgcctacgccgggtacctggcgctcggcgcgctgcttgtggcgcggctggagcggccgcacgaagcccggctgcgggcagagctggggacgctgcgggagcagctgctgcggcacagcccgtgcgtggcggctcacgccctggacgccttcgtggagcgggtgctggcggcaggacggctggggcgcgcagtgctggccaacgcatcgggacccgccaacgcttcggaccccgcgtgggactttgcctcggcgctcttcttcgccagcacgctagtcaccaccatgggctatggctacacgaccccactgacggatgcaggcaaagccttctccatcgtttttgcactcctgggcgtgcctatcaccatgctacttctgactgcctcagcccagcgcctgtcactgctgctcacccacgcacccctgtcctggctgagcctgcgctggggctggcacccgcagcgggcagcccgctggcacctggtggccctactgatggtcatagtggctatatttttcctgatcccggctgcggtcttcgcctaccttgaggaggcctggagctttctggatgctttctatttctgcttcatctctctgtccaccattggcctgggggactatgtgcctggggaagccccgggccagccttaccgatccctctacaaggtgcttgtcacagcatacctcttcctcggccttgttgccatggtgctggtgttgcagactttccgccgtgtttctgacctccatggcctcactgaactcatcttgctgccggatcccgaccctgccaggctccaccaggatgaggatgaccaggtggacattctggatgcccggacagatctgcatcagcatctctctgctgcctcccacgctaattacgcctccatccccaggtagctgtcgacctggacacacctggcctgggctttgggccccatgtgattagatcaactagaaagcccactcacactctccactgggaggtgaggagtagccgctttgctcctgtgtcctccgctcctcagggccctgacacagtcattttctcctcctatcttttctcccatttcttctcagactctgaccgtttgggctttctgactttgtgagagtggtggtttctatgcctttttgtttygttttgttcttgttcttctgtatctcactctcttgcatagtacatctggcacatccagttcttctgggctccaaccctgggctccatttcagccagtgaggtaaactgaccgactggtcccttgacagtgacaagctccagtgggcaccagaagaggcaagagtagccaggactgaggagtgaacctgatatgttcagggttatctttcctggggacaggaactaacccaagacctgctagtcaagagaaaaaatagtcccttctcctcaggtgtctatgggccatagtacctgtgggaagaggcctgcaatgggccagcatctccctcagtgacttaacaggcaaggaactgacccaggatatgagccgagatccaagtggcatgagacaagcagcttagcgtagttcctgtggtgataccatgtcttttactgggcattgatagccgtgggctctggagccagtcttcctgggcgtgccctgtgactgggccatgtttcaccaatgcatttggacggtcactctacctttcagactctgtctcctaaatggtgaccataataacgcttactctaaaaggcgaactcaaccagtagcacatgcctgtaacctgagctgaagcaggaggcttgagagttcaaaggcaggagccaggcaataaaacaatgtaagcaataaaataataataatgatgahgawrawggtggtggtgatgatgatgatgatatgttcaatggaatatagtgccaggcttaaagggacatgagagtaggctatagaaggatgtataaccctcagggctgggacttattttatttatacaatatatcacttaaagattttggcaggggaaaaaaaaaagattttggcgggctggagagatggctcagcggttaagagcacccgaacgctcttccagaggtcctgagttcaattcccagcaaccacatggtggctcacaaccatctgtaaagagatctgatgccctcttctggtgtatctgaagacagctacagtgtacttatatataataaataaataaatcttcaaaaaaaaaaa

SEQ ID NO: 2032 - DNA, 1923 bp, Rattus norvegicus
  Genbank Accession No. NM_053812
ccgggagctgctagctcctctatggtcacaaagtctcgaggcttctcgggctaaaaggcgactcaaggcggcatccagcaccatgaattcactgatagcagttcctgccagtcaggcctgaaaccttggccccgggagcagccaggagcccttccggatctttgtcttcaaactgctgggccattccacatctggagcagtcaggcaggtgacaagtgagggtaccctccaccaagaccggaaaaatggcatccggacaaggaccaggtcctcccaagggggactgcgatgaggccctgtctgcttctgaacagcaagttgcccaggacacagaggaggtctttcgaagctacgttttttacctccaccagcaggaacaagagacccagggggcagccgcccctgctaaccctgagatggacaacttgtccctagaacccaacagtgtcttgggtcaggtgggtcggcagcttgctctcatcggagacgatattaatcggcgctacgacacggagttccagaatttactggaacagcttcagcccaccgctgggaatgcctacgaactcttcaccaagatcgcctccagcctatttaagagcggcatcagctggggccgtgtggtggctctcctgggctttggctaccgtctggccctgtatgtctaccagcgtggtttgactggcttcctgggccaggtgacctgctttttggctgatatcatactacaccattacattgccagatggattgcacagagaggtggttgggtggcagccctgagtttgcgtagagaccccatcctgagtgtagtggtaatttttggtgtggttctgttgggccaatttgtggtacacagattcttcagatcatgactgccccgggagctccagccacatgactgcctggactaaactaaacctctccccaacccactcccctgcaacagtcctctcctgcctctcagggcaaacaggcacccctgctttggaaagccacggcccgggggtcatggaggcagcatgaccaccccaacatcgcatggtgctactgaaccccatcctgtctcagaggggctgacagatgctctgggggggggggggtcgggcaagaggctgggccaccgcttcccagaaagttagttttagttttatactcccctctggatacaatcctcccttttcatccgctctgcccaaagtcagaacattggggaccagtggctctaacctgccttcccagcacacctgctactttggaaggtcggaagggacctaagcacagtcctgaccctccctacataggaccagctgtaggggtgtgtgatctaccctgccctcccacctcatcttccactatcccctcctttatcccccctccttctcccctcccctcccccgatccatttttgcctttgcggctggactctcagggattccgagcccagagtgagggcagaggtgagagctcagaccacagctgtctgaacacgtccatcaaggccctccaaaccccaagtgcctccctgaccactgctaccaacctagtgggtaagggaagaccctcaccttctccccagtgcctccctgctggggagggcagtcactctgacaggggaaggggtgggcattcagtgggaggtgctcacgctagagaactacaccagcaaaagcaactgtggatctggttgcaatgtgaccccccctaaacctgtgaatacttgaaccccaccttcacccatgctcctgttatgcctaggtcctcctcgggtggggtggggggtgtttttctctgtcttgcacaacataggggtgagaaaagtcttgattaagccaaatgtagcaagggtggggggaggcagatggattcccccacctcgccctcggtgtctggaaataaacggtgcaatgcccccaacacccc

SEQ ID NO: 2033 - DNA, 2558 bp, Rattus norvegicus
  Genbank Accession No. NM_053818
ctcttgaggcctcttgtctgagaggcactgaacgcaggagtctgcaggtgtggtccagatctccagatcccccaacccactgccaccatggtaggaaaaggtgccaaagggatgctgaatggtgctgtgcccagcgaggccaccaagaaggaccagaacctcacacggggcaactggggcaaccagatcgagtttgtactgacgagcgtgggctatgccgtgggcctgggcaatgtgtggcgtttcccatacctctgctatcgcaacgggggaggcgccttcatgtttccctacttcatcatgctggtcttctgcggcattcctctcttcttcatggagctctccttcggccagtttgcaagccagggctgcctgggggtctggaggatcagccccatgttcaaaggcgtgggctatggtatgatggtggtgtccacgtacatcggtatctactacaacgtggtcatctgcatcgccttctactacttcttctcgtccatgacgcatgtgctgccctgggcttactgcaataatccctggaacacacctgactgtgccggtgtgctggatgcttccaatctcaccaatggctcccggcccactgccctgtctggcaacctgtctcacctgttcaactacaccttgcaaaggaccagccccagtgaggagtactggaggctgtatgtgctgaagctgtcggatgacattggagattttggagaagtgcggcttcctctcctaggctgccttggcgtctcctgggtggttgtcttcctctgcctcattcgaggagtcaagtcttcagggaaagtggtgtacttcacggccacatttccctatgtggtgctgaccattctgtttgttcgtggagtgaccctggaaggagccttcacgggtatcatgtactacctgaccccaaagtgggacaagatcctggaggccaaggtgtggggggatgcagcctctcagatcttctattccctgggctgtgcatggggtggcctcatcaccatggcatcctacaacaaattccacaacaactgctaccgggacagcgtcatcatcagcatcaccaattgtgctaccagtgtctatgctggcttcgtcatcttctctatcctaggcttcatggccaatcacctgggtgtggatgtgtctcgggtggcagaccacgggcccgggctagctttcgtggcttaccccgaggctctcacactgcttcccatctccccgctctggtccttgctgtttttcttcatgctcatcctgctgggactcggtactcagttctgcctcctggagaccctagtcactgccattgtggatgaggtggggaatgagtggattctgcagaagaagacctacgtgaccttgggtgtggctgtggctggcttcttgctgggtatccctcttaccagccaggcgggcatctactggctgctgttgatggacaactacgcagccagcttctccttggttgtcatctcctgcatcatgtgcgtgtccatcatgtatatctatgggcaccggaactacttccaggacattcagatgatgctggggttcccaccgcctctcttcttccagatctgttggcgttttgtctctcccactatcatctttttcattctcatcttcacggtgatccagtaccggccaatcacttacaaccactaccagtacccaggctgggctgtggccatcggcttcctcatggctttgtcgtctgtcatctgcatcccattgtacgcattgttccagctctgccgcacagatggggacacacttcttcagcgtttgaaaaatgccacaaagccaagcagagactggggccctgccctcctggagcaccggactgggcgctatgcccccactacaaccccctctcctgaagatgggtttgaggttcagccactgcacccggacaaggcccagatccccatcgtgggcagtaacggctccagccgcctccaggactcccggatatgagcacagttgttgcaaggggagaagccccacccaacccttgctcctaccacagagactgaggaggtggtggaccggtgtgactgcctgccccatcatgccctggccagggtggctgctgtcaccttggccaccactgctcatgtccccagtgtttacacatcctttggatgccaagacagcagctgggggtggaaaagtgatgggggtgggggggaggtgcgtgggggtggggcatggggcggcagtgtccaaagcactttggaggaggtctcaggccatgtccccagaggcttccaggcttcattatccctcatgctctgccctgagctgtttcactacgggataagaggttttgtttccacaccccacctgttcccctccagcctcatgaccagtgttcctgaccccagaacagaccctagcctcttgcccaggcaaatctgtatcttcctgctccggacaaggtgaggcgcccgggggctgtacagtgttacttgttggactgcaccactcagccctgtttatttgtgtaattatttttttaaaaaattgtattacctgtggttgcc

SEQ ID NO: 2034 - DNA, 740 bp, Rattus norvegicus
  Genbank Accession No. NM_053819
cggactcctagagacacgctagagcagataccacgatggcgccctttgcatctctggcctctggcatcctcttgttgctatcattgatagcttccagtaaagcctgtagctgtgccccaacccacccacagacagctttctgcaactcggacctggttataagggctaaattcatgggttccccagaaatcatcgagaccaccttataccagcgttatgagatcaagatgactaagatgctcaaaggattcgacgctgtgggaaatgccacaggtttccggttcgcctacaccccagccatggagagcctctgtggatatgtccacaagtcccagaaccgcagcgaggagtttctcatcgcgggccgtttaaggaacggaaatttgcacatcactgcctgcagcttcctggttccctggcataatctgagccctgctcagcaaaaggccttcgtaaagacctatagtgctggctgtggggtgtgcacagtgtttccctgttcagccatcccttgcaaactggagagtgacagtcattgcttgtggacagatcagatcctcatgggctctgagaagggctaccagagcgatcactttgcctgcctgccacggaatccagatttgtgcacctggcaataccttggggtctcgatgacccgaagccttcccctggcaaaagctgaagcctgaacactgtttacctttcctccatctttctttctcttaaatggtgaaataaag

SEQ ID NO: 2035 - DNA, 361 bp, Rattus norvegicus
  Genbank Accession No. NM_053822
gcacgaggtgaaaggaaatttttatcgacatggcaactgaactggagaaggccttgagcaacgtcattgaagtctaccacaattattctggtataaaagggaatcaccatgccctctacagggatgacttcaggaaaatggtcactactgagtgccctcagtttgtgcagaataaaaataccgaaagcttgttcaaagaattggacgtcaatagtgacaacgcaattaacttcgaagagttccttgcgttggtgataagggtgggcgtggcagctcataaagacagccacaaggagtaacagagcttctggcctgggctgggtcccttggatatgtctacagaataaagtcgtcatatctt

SEQ ID NO: 2036 - DNA, 982 bp, Rattus norvegicus
  Genbank Accession No. NM_053835
gggagctgacagcagccacgcggggaagatggctgaggacttcggcttcttctcgtcgtcggagagcggggcccccgaggccgccgaggaggacccggcggccgccttcctggcccagcaggagagcgagattgctggcatcgagaatgactcgggtttcggggcacctgccgccagccaggtggcctctgcgcagcccggactcgcgagcgggggtggttcggaggacatggggactacagtcaatggagatgtgtttcaggaggctaacgggcctgccgatggctacgctgcgattgcccaggcggacaggttgactcaggagcctgagagcatccgcaagtggagagaggagcagaagaaaaggctgcaggagttggatgctgcctcgaaggtgaccgaacaggagtggcgggagaaggccaaaaaagacctggaggagtggaaccagcgccaaagtgaacaggttgagaagaacaagatcaacaacaggatcgctgacaaagcgttctaccagcagccagatgctgataccattggctatgtggcatcggaagaggcttttgtgaaagaatccaaggaggagaccccaggcacagagtgggagaaggtggcccagctgtgtgacttcaaccctaagagcagcaagcaatgtaaagacgtgtcccgcctgcgctcggtgctcatgtccctgaagcagacgccactgtcccgctagtgcctgtcaccacgggccttggtggggcagagcagcagctgcttcagccagggtggaacttctctggcagctgccacacacgcctgttctgttcctctgagtctctgggagctgggaagcgggacccttacccctttcacccaccctgtccttcctggtcccctgttccagcccctcatgactcctgtcagtccacttgattgtgactgtccctcctgatgtatttttcttggcttaaagggtgtgttaactctttttacactt

SEQ ID NO: 2037 - DNA, 1318 bp, Rattus norvegicus
  Genbank Accession No. NM_053843
acctcatcagactctgacccagttcttgaatgactttggagacccagatgtttcagaatgcacattctggaagccaatggctactcccaccactgacaatgttgctgctgtttgcttttgcagacaggcagacggcaaatcttccgaaggctgtggtgaaacgtgatcccccatggatccaggtgctcaaggaaggcactgtgacgctgacgtgcgaagggacccacaatcctggaaactcttctacccagtggttccacaaccagagctccacctggggccaggtccaagccagctacacgtttaaggccacagtcaatgacagtggagaataccggtgccgaatggcgcacaccagcctcagcgaccccgtacatctggaagtgatttctgactggctgctgctccagacccctcaactggtgtttgaggaaggggaaaccatcacattaaggtgccatagctggaagaacaaacagctgactaaggtcttgttgttccagaatggaaaacctgtgaggtattattatcaaagcagcaatttttcaatccccaaagccaaccacagtcacagtgggaactactactgcaaagcatatctaggaaggacaatgcatgtgtccaagcctgtcaccatcactgtccaaggttcagcaacggcatccaccagctctctagtgtggttccatgccgctttctgcctagtgatgtgcctcctgtttgcagtggacaccggcctgtatttctgtgtacggagaaatcttcaaacctcgggggaggactggaggaaatccctgtcagtcggaaagtacaaggctccacaggacaaatgacatcccatcgtatggctaaacagcggcagcttcttttcagccacaccgccgcttcatctacagccttcctttgaaagcaacttaccaccaggctggatatttggtcctgcaatcacaactgctaggaggctgaggcaggagggtcaccaaaggctgcccgggttttagagaagagagagtgcaagtctatcctggataacccaataagaccctgggtttagatggcttatcaggaaagagcacccattgctaagctcacagacaagaccacagattgatccctaaggacacagggcaaagggagagaacaaattcctgaaagttgtcctctgacctccacacgtccaccatggcagatgcacacaataaacaaattaaaatgtaatatatatattttaaacaagaggtggggaaaggctgggggttggtggcacagtttttatccaggacacatgatgctctggattttgacctcctataataaa

SEQ ID NO: 2038 - DNA, 843 bp, Rattus norvegicus
  Genbank Accession No. NM_053857
gggccgaggtgccgcggggttgctggagggtcgtgggcggcgtgcaggagacatgtcggcgggcagcagttgcagccagactcccagccgggctatccccactcgccgcgtagccctcggcgacggcgtgcagctcccgcccggggactacagcaccacccccggcggcacgctcttcagcaccaccccgggaggaaccagaatcatctatgaccggaaattcctgatggagtgtcggaactcgcctgtggccaaaacacccccaaaggacctgccaaccattccaggggtcactagccctaccagcgatgagcctcccatgcaggccagccagagccatctgcacagcagcccggaagataagcgggcaggtggtgaagagtcacagtttgagatggacatttaagggaccagccataggacgcagtgatgcttctgggcccctggggcccttgggaggagagccacagcagtcaggccttgtacccggcagacactgggtgtggatcggccacccagtcctgctcctcactcagggcacctgctctgccttccattttgtgaataccagcacatacctccttgtgcctctgttgatactgagctgctactccagggtaatgactctcacctacaccctccctgcatcaagcgccagcgagtggacacagaggagtctgtcggaatgatctggcaattctagccccaacctctggagcacacccaccttaccttaggttggggtacctgggaaagccaccctttacttctttccctgagaggaaataaaagccacatttaccctaggcccacagccgggccctgtctgaaaaaaaaaaaaaa

SEQ ID NO: 2039 - DNA, 2024 bp, Rattus norvegicus
  Genbank Accession No. NM_053859
gaattcggcacgagcggagctgcggggccgggccgggccggggcggaccccgggatcccggacgcggccgcccgggcccgcgggcggggggattggcaggggacccgcgtgggcacagccaccatggagttccggcaggaggagtttcggaagctggcggggcgcgccctggggaggctgcaccggttactggagaagcggcaggaaggcgcggagacattggagctgagcgccgacgggcgcccagtgaccacacacacgcgggacccgccggtggtggactgcacttgctttggcctccctcgccgctacatcatcgcgatcatgagcggtctgggtttctgcatcagctttggcatccgctgcaacctgggcgtggccatcgtatccatggtcaacaacagtacaacccaccgtgggggccacgtggtggtgcagaaagcccagttcaactgggatccagagactgtcggcctcatacatggctcctttttctgggggtacattgtcactcagattcctggaggatttatctgccaaaaattcgcagccaacagggtctttggctttgccattgtggctacctccaccctaaatatgttgatcccttcagcagcccgtgttcactatggctgtgtcatcttcgtgaggatccttcagggattggtggagggggtcacataccctgcttgccatggcatctggagcaaatgggcccctcccttagaacggagtcggctggcgacgacagccttttgcggttcctatgccggggcagtggttgccatgcctctggctggggtcctggtacagtattcaggatggagttctgtcttctatgtctatggcagcttcgggatcttttggtacctgttctggttgcttgtctcctacgagtcacctgcactacaccccagcatctccgaggaggagcgcaaatacattgaggatgccatcggagaaagcgccaagctcatgaaccctgttacgaagtttaacacaccctggaggcgcttctttacctccatgccggtctatgccatcattgtcgccaacttttgccgcagctggactttctacctgctcctcatctcccagcccgcctactttgaagaagtgttcggctttgagatcagcaaggtgggactggtgtcggcactgcctcaccttgtcatgactatcatcgtacccatcggaggccagatcgccgacttcctgcgcagtcgtcatataatgtccacgaccaatgtgcgaaagctgatgaactgcgggggtttcgggatggaagctacgctgctgctggtggtcggatactcacactccaagggcgtggccatctccttcctggtcctggctgtgggcttcagtggctttgctatctctgggtttaacgtgaaccacttggacatcgcccctcgatatgccagcatcttgatgggcatttccaatggcgtgggcacactgtctgggatggtgtgccccatcatcgtgggtgcaatgaccaagcacaagacgcgggaggagtggcagtacgtgttcctcatagcctccctggtgcactatggaggtgtcatcttctatggggtctttgcttcgggagagaaacagccgtgggcagagccggaggagatgagcgaggagaagtgtggctttgttggccacgaccagctggctggcagtgacgaaagtgaaatggaagacgaggttgagcccccgggggcaccccccgcacctccgccttcctacggggccacacacagcacagttcagcctccaaggcccccaccccctgtccgggactactgaccacgtgcctcccactggtgggcagtttccaggacctccactcgatacacctctagcctaaacggcagtgtcgaggaaccccactcctctcctgcctcaggcttaagatgcaagtcttcccttgtgcccagtgctgtccgaccagccctctctccttctcaactgcctcttgcaggggtgaagctgcacactagcagtttcaagctcgtgccgaattc

SEQ ID NO: 2040 - DNA, 2401 bp, Rattus norvegicus
  Genbank Accession No. NM_053863
cctgacgctgccttctcactgcagataagtgagtagtacaggaccctctcccctctctatgcagccctgtgtctgtgagtgcccagggagcaggcatttaccaggtctggtggctgcgtgttccacacgtcctcatgaggctgaagagccaagcacatggcagacaacacacagaggcaaagagagtccatttccctcacgcctatggcccacggcctggagaacatgggggcagaattcctggaaagcatggaggaaggccgactccctcacagtcactcaagcctgccggagggtgaaggtggcctgaacaaagcagagcggaaggccttctcccgatggaggagtctgcagccgactgtgcaagcgagaagcttctgcagggagcaccggcagctgtttggatggatctgcaaaggcctgctctctactgcatgtcttggcttcttgatggtcgcctgcctcctggacctccagagggccctagcactgttgatcatcacctgtgtggttctcgtctttctggcctatgatctgctaaagaggcttctggggtccaagctgaggaggtgtgtgaagtttcaaggccattcttgcctgagcctctggctgaaaagaggtctagcccttgctgctggtgtgggcctgatcttgtggctatctctggacaccgcccagcggcctgaacagctggtgtcctttgcagggatctgtgtgttccttgtccttctctttgctggctcaaagcatcaccgtgcggtgtcatggcgagctgtgtcctggggccttgggctgcagtttgtgcttgggctcttcgtcatcagaacagaaccagggttcattgcattccagtggctaggggatcagatccaggtcttcctgagttacaccgaggcaggctccagcttcgtcttcggagaggctctggtgaaggatgtctttgcctttcaggttttgcccatcatcatcttcttcagctgcgtcatgtctgttctgtactatctgggcctcatgcagtgggtgatcctgaagattgcctggttgatgcaggtcaccatgggcacctcagccaccgagacactgagtgtggcgggaaacatctttgtgagccagactgaagctcctctgctgatccggccctatctggcagacatgacactctctgaagttcacgttgtcatgactggaggctatgctaccattgctggcagcctcctgggcgcctacatctcctttgggatcgacgctgcttccttaatcgcagcctctgtcatggccgccccttgtgcgttggctctctccaagctggtctacccagaggtggaggagtccaagttccggagtgagaatggcgtgaagctgacctatggagacgctcagaacctcttggaagcagccagtgctggggctgccatctcagtgaaggtcgttgccaacattgctgccaatctgattgccttcctggctgtactagccttcgtcaatgctgccctctcctggctaggggacatggtggacatccagggactcagcttccagctcatctgctcctacgtcctgcggcctgtggccttcttgatgggtgtggcctgggaggactgtccggtagtggctgagttgctgggcatcaagttctttctgaatgagtttgtggcctatcaagagctttcccagtacaagcaacgacgcctggcaggggctgaggagtggcttggtgacaagaaacagtggatctctgtcagagcagaaatcctgactacatacgccctctgtggatttgccaacttcagctccatcggcatcatgttgggaggcctgacctccctagtcccccagcggaggagcgacttctcccagattgtactccgggcactgatcacaggggctttcgtgtccctgctaaacgcctgtgtggcagggatcctctatgtacccaggggggtcgaggtggactgcgtgtcccttctgaaccaaactgtcagcagcagcagctttgaggtttacctgtgctgccgccaagtcttccagagcactagctcggagttcagccaagtggcactggacaactgctgtcgattttacaaccacacagtctgcacatagctgggacggagcatcttcctagcctcagggctcatccagcccagagaggccgtgggactcgtcactacctccatcccacaattgggaagggtgcaacggtcatcgctgctcccatgtctgcctctccaagtacgagttcccagagtctggtctgctctcctgccctttgggagccaacattctggtcctcttgagtcctctttccttgggaacctcatgtgcaccagccaaaagcctcctccctgctccctcccaagcacccagcttgttgggtatccccccaaaagctgtctctaga

SEQ ID NO: 2041 - DNA, 2104 bp, Rattus norvegicus
  Genbank Accession No. NM_053883
gcacgagacggggttggatctgaggtgcagcctcagagggattaggagctgctagacttttttcttttttcctttttctcctctcagtggcacggagtccgaattaattggatttcattcactgggtaggaacaaaactgggcactttcattcagagagattcattgactctgagagtgatctggtgcagagggaccaccggcttggcttctgtcgccttccctaaccgctagcttcggcttgggaaaggccgaatcaaacccggctccgagagccggagcttctcacggcttgcttggcctatgcctgcctcgaggggcgtctgctaggcaccccgccttctcctgcagctcgacccccatgatagatacgctcagacccgtgcccttcgcgtcggaaatggcgatcagcaagacggtggcgtggctcaacgagcagctggagctgggcaacgaacagctgctgctgatggactgccgaccgcaggagctgtacgagtcgtcgcacatcgaatctgccatcaacgtggccatcccgggcatcatgctgcggcgtctgcagaagggcaacctgccggtgcgcgcgctattcacgcgctgcgaggaccgggaccgctttaccaggcgctgcggcaccgacaccgtggtgctctacgacgagaacagcagcgactggaatgagaacacaggtggagagtcggtcctcgggctgctgctcaagaaactcaaagacgagggctgccgggcgttctaccttgaaggtggcttcagtaagttccaggccgagttcgccctgcactgcgagaccaatctagacggctcgtgcagcagcagctccccgcccttgccagtgctgggactcgggggcctgaggatcagctccgactcttcctcggacattgagtctgaccttgaccgagaccccaatagtgcaacggactccgatggcagcccgctgtccaacagccagccttccttcccggtggagattttgcccttcctttacctgggctgtgccaaggactctactaacttggacgtgttggaagagtttggcatcaagtacatcttgaacgtcacccccaatctgcccaatctgtttgagaatgcaggggagttcaagtacaagcaaattcctatctctgatcactggagccaaaacctgtcccagtttttccctgaggccatttctttcatagatgaagcccgaggcaaaaactgtggtgtcctggtgcattgcttggcgggcatcagccgctccgtcacggtgacagtggcttaccttatgcagaagctcaacttgtccatgaacgatgcttatgacattgtcaaaatgaagaagtccaacatctctcccaacttcaacttcatgggccagctgcttgactttgaaaggaccctgggactcagcagcccctgtgacaatcgtgtccccgcacagcagctctacttcaccgcgccctccaaccagaatgtctaccaagtggactccctgcaatctacgtgaaaggcacccacctttcctagccgggagtgtctcattccttcagtttctcttgggcagcatcgaccaggctgctttctttgtgtgtggccccaggtgtcaaaaatgtcaccagctgtctgtattagacaaggttgccaagtgcaaaattggttattacggagggagagatttgctccattcattgttttttggaaggacagggtatgctgtctagatccaggcaataggtttgcttttgtaccccagcctacccaagcagggactggacctccatccagatagagggtaggacaaaggagccggggataggagcatgtgttccttagggccacatatggctgtttcctgttgcatctggaaccaactatattgtcttcagtgaagactgattcaactttgcgtatagtggagccaaagagattttagctctgtatttgtggtatcggttttgaaaacaaaagaactgatcctttaatttgattattgtaaatatttgatcttcacttgagagtgtttgtttggcttgtgtttggtttttaatctttgggtttaaacgagatccaaagggagaaagagcagtatgcctcgtgccgaattc

SEQ ID NO: 2042 - DNA, 5180 bp, Rattus norvegicus
  Genbank Accession No. NM_053887
gaattccgcacccggggcgggacaagaggtctgctttccaaagagaaggcttcgcgtctgtctgcagcaggcgacagtcccgggcgccacctgcgcttcgggcgcgggccaggctggtgcgcgccgggcccccagcgcccgctactgagagcgtgaagtgaccgaccgtgagtcctccggcttgcgtccccttccagcaccagggactcacgccccaattactgcttgctcaagggtggacgagctccggccgagccgctgccccgccccgtactacctggcagctgcccgggtgcagcgcacagcgccccgcgcggccccagcagagcccctgccctcccacctgcgccgcgcgcccgccgctccgtgctcccgagacaggagacgcggccccgctcccgctcgcgcccgcgcactcggcgcagcgcgcgcgcccgccgctccgcccgccccccgcgctctccccgccccctccctcccccgcaggcacgagcgaatgtagcccgcgagagaaaatggcggcggcggcgggcgatcgcgcctcgtcgtcgggattcccgggcgccgcggcggcgagccccgaggcgggcggcggcggcggagctctccagggaagcggcgcgcccgcagcgggcgcggggctgctgcgggagactggcagcgcgggccgcgagcgcgcggactggcggcggcagcagctgcgcaaagtaaggagtgtggagctggaccagctgccggagcagccgctcttcctcaccgcctcgccgccctgcccatctacttccccgtcgccggagcccgcggacgcggctgcaggagcgagtggcttccagcctgcggcgggaccgccacccccgggagcagcgagtcgctgcggctcccactctgccgagctggcggccgcgcgggacagcggcgcccggagccccgcgggggccgagccgccctctgcagcggccccctccggtcgagagatggagaataaagaaaccctcaaaggattgcacaagatggatgaccgcccagaggagcgaatgatcagggagaagctcaaggcgacctgtatgcctgcctggaagcacgagtggttagaaaggaggaacaggagaggccctgtggtggtgaaaccaatccctattaaaggagatggatctgaaatgagtaacttggcagctgagctccaaggagagggccaggcaggctctgctgcaccagctcccaagggccgacgaagcccgtctcctggaagctccccatcagggcgctcagggaagccggaatccccaggagtgagacggaaacgagtgtccccagtgcctttccagagtggcagaatcacaccacctcgaagagccccgtcgccagatggcttctcaccgtacagcccagaggagacgagccgccgtgtgaacaaagtgatgagggccaggctgtacctcctgcagcagataggacccaactctttcctgattggaggagacagtccagacaataaataccgcgtgtttattgggccacagaactgcagctgtgggcgtgggacattctgcattcacctcttgtttgtcatgctccgggtgttccagctagaaccctccgaccccatgctatggagaaaaactttaaaaaattttgaggttgagagtttgttccagaaataccacagtaggcgtagctcaagaatcaaagctccatctcggaacaccatccagaagtttgtctcacgcatgtcaaactgtcacacattgtcatcgtctagcacatccacatctagttcagaaaacagcatcaaggatgaagaggagcagatgtgtcccatctgcttgttgggcatgctggatgaggagagcctgactgtgtgtgaagacggctgcaggaacaagctgcaccaccactgcatgtcaatctgggcagaagaatgtagaagaaatagagaaccgttaatatgtcccctttgtagatctaagtggagatcccatgacttctacagccatgagttatcaagccctgtggattcccctacctccctgcgaggtgtacagcagccctcctccccgcaacagcctgtggccggatcacagcggaggaatcaggaaagcaattttaaccttactcattatggaacccagcagattcctcccgcttacaaagatttagccgagccatggattcaggcattcggaatggagctcgttggctgcttattctctagaaactggaacgtaagggagatggcccttaggcgcctttcccacgatgttagcggggccctgttgttggcgaacggggagagcactggaacttctggaggcggcagcggaggcagcctaagtgctggcgccgccagtgggtcttcccagcccagcatctcaggggacgtggtggaggcgttctgcagcgtcctgtctatcgtgtgcgctgaccctgtctacaaagtgtacgttgctgctttaaaaacactgagagccatgctggtatacactccttgccacagcctggcagaaagaatcaaacttcagagacttctccggccagtggtagacaccatcctagtgaagtgcgcagacgccaatagccgcacgagtcagctgtccatatcaacactgttggagctctgcaagggccaagcgggggagttggcagttggacgagaaatacttaaagctggatccatcggtgttggtggcgttgattacgtcttaagttgtattcttggaaaccaagctgaatcaaacaactggcaagaactcctgggtcgcctctgtcttatagacagattgctcttggaaatttctgcggaattttatcctcatattgtcagtaccgatgtctcacaagccgagcctgttgaaatcaggtataagaagctgctgtccctcttagcctttgccttgcaatccattgacaattcccactctatggtcggcaaactctcgcggaggatttatctgagctcagcacgaatggtgaccacagtgccccccctgttttccaagctggtaaccatgctaagtgcttctggatcctcccacttcgccaggatgcgccggcgtctgatggccattgcagacgaggtagaaattgccgaggtcatccagctgggttcggaagacactttggatggccagcaggacagctcgcaggcattggcccctccccgctatccagagagcagctcccttgagcacacagcccatgtagagaaaactggaaaaggattaaaagctacgagactgagtgccagctcagaggacatttctgacagactggctggcgtttctgtaggacttcctagttcagcaacaacagaacaaccaaagccaacagttcaaacaaaaggcagaccccacagtcagtgtttgaactcctctcctttgtctcctcctcagttaatgtttccagcaatatcagccccatgttcatctgccccgtctgtcccagctggctctgtaacagatgcttctaagcatagacctcgggcgtttgttccctgtaaaataccctctgcgtctccccaaacacagcgcaagttttccctacagttccagaggacctgctctgagaaccgagactcagaaaaactctccccagtctttactcagtcgagacccccaccctccagtaacatacacagggcaaaggcatcccgacccgttccgggtagcacaagcaaactaggggatgcctcaaaaaacagcatgacactcgacctgaacagtgcttcccagtgtgatgacagctttggcagtggcagcaacagtggcagcgccgtcatacccagtgaggagacggcattcaccccagcagaggacaagtgcaggttagatgtcaaccccgagctcaactccagtatcgaggaccttcttgaagcatctatgccttcaagtgacacaacagtcactttcaagtccgaagtcgccgtcctctctcctgagaaggccgaaagtgatgacacctacaaagatgacgtcaatcacaatcaaaagtgcaaagagaagatggaggctgaggaagaggaggcgctcgcgattgccatggcaatgtcggcttctcaggacgccctccccatagtccctcagctgcaggtggaaaatggagaggatatcatcatcatccagcaggatacaccagaaaccctaccagggcataccaaagcgaacgagccctacagagaagacaccgagtggctgaaagggcagcagataggcctcggagcattttcttcttgttaccaagcacaggatgtgggcactggaactttaatggctgtgaaacaggtgacctacgtcagaaacacatcttctgagcaggaggaagtggtggaagccttgagggaagagatcaggatgatgagccacctcaaccatccgaacatcatcaggatgctgggggccacgtgcgagaagagcaactacaacctcttcatcgagtggatggcgggagcctccgtggctcacctcttgagtaaatatggagctttcaaggagtcagtggtcattaactacacagagcagttactccgtggcctttcctatctccacgagaaccagatcattcacagagacgtcaaaggggccaatctgctcattgacagcaccggtcagcggctgagaattgcagacttcggtgctgccgccaggttggcatccaaaggaactggtgcaggagagttccagggacagttactggggacaattgcattcatggcgcctgaggtactaagaggtcagcagtacggtaggagctgtgacgtctggagtgttggctgcgccattatagaaatggcctgtgcaaaaccaccctggaacgcagaaaagcactccaatcatcttgctttgatatttaagattgcgagtgcaactactgcaccatccatcccgtcacacctgtccccgggcctgcgagacgtggctctgcgctgtttagaacttcaacctcaggacagacctccgtcaagagagctactgaagcatcctgtcttccgtacaacatggtagtcaactgctcagggtgcgcaacaaggaaagaaaactcgcgggcagccacgttgatagtctgctggcctcataccactgaccagaagaggggccagtggggagcccgcacctaagcatgtgactgacaaatcatgactgcacctgagctccgtctgcagacggctacaactcgtgcaggagctg

SEQ ID NO: 2043 - DNA, 1208 bp, Rattus norvegicus
  Genbank Accession No. NM_053891
gaattccgccccgcccgggctgagaaccatcttgttttccacgcagatccgcagggctacacgcgtcgtgtcccgggagcgcctcctttctcctcgcggccgctacaggcttggtaagcctttttctccctccggccggcaggctgggcgcgcaggggtgccggcccctgccgggcgcgcagtggcaccatgggcacggtgctgtccctgtcccccagctatcgaaaggccacactgtttgaggatggcgcggccaccgtgggccactacacggccgtgcagaacagcaagaacgccaaggacaagaacctgaagcggcactccatcatctcggtactgccttggaagaggatcgtggcggtgtcagcgaagaagaagaactccaagaaggcgcagcccaacagcagctaccagagcaacatcgcccacctcaacaatgagaacctgaagaagtcgctgtcgtgtgccaacctgtccacgttcgcccagcccccgccggcccagccgcccgcacccccagccagccagctttctggctcccagactggggtctcctcttctgtcaagaaggccccgcaccctgccatcacctccgcaggaacacccaaacgggtcatcgtccaggcgtccactagtgagctgctgcgctgcctgggtgagtttctctgccgccggtgctaccgcctgaagcacttgtccccaacggaccccgtgctctggctgcgcagcgtggaccgctccctgcttctgcagggatggcaggaccagggtttcatcacaccggccaatgtggtcttcctctacatgctctgcagggatgttatctcctctgaggtgggctcggaccacgagctccaggctgtcctgctgacctgtctgtacctctcctattcctacatgggcaatgaaatctcctacccgctcaagcccttcctggtggagagctgcaaggaagccttttgggaccgttgcctctcagttatcaacctcatgagctccaagatgctgcagatcaatgctgacccacactatttcacacaagtgttctctgacttgaagaatgagagtggtcaggaggacaagaagcgactcctcctggggctcgatcggtgagccccctgtagctggtatcctggctcaaggattccattcgtttttaaaatttattattaaagaatcaagtttgtgtacagtatgtgtctagcaga

SEQ ID NO: 2044 - DNA, 2240 bp, Rattus norvegicus
  Genbank Accession No. NM_053896
gaattccggcttccagcgagatcgccatgcccggcgaggtgaaggccgaccccgccgcgctcatggcctcgctgcagctcctgccgtcacccacgcccaacctcgagatcaagtacaccaagatctttattaacaatgaatggcagaactcagagagtgggagagtgttccctgtctgtaatccagccacaggagagcaagtgtgtgaagttcaagaagcagacaaggtggatatagacaaggcagtgcaggcggcccgcctggccttctctcttggttctgtgtggagaaggatggacgcttctgaaagaggacgtctgctggacaagcttgcagacttggtggaacgggacagggcaactcttgcaactatggaatcactaaatggcggtaagccattcctgcaagctttttacatcgatttgcagggagtcatcaaaaccctgaggtattatgcaggctgggctgataaaattcacggaatgaccattcctgtagatggagactattttaccttcacgagacatgagcccatcggagtgtgtggacagattatcccgtggaatttccccctgctgatgttcacctggaaaattgctcccgcactgtgctgtggtaacactgtggtcatcaagcctgcagagcagacaccactcagtgcactgtatatgggagccctcatcaaggaggctggctttccacccggggtcgtcaacattctgccagggtatgggccaacagcaggggcagcaatagcgtctcacattggcatagacaagattgcattcacaggctctactgaggttggaaagcttattcaagaagcagctggaagaagtaatttgaagagagtaactctggaacttggagggaaaagccctaatattatttttgcagatgctgacttggactacgctgtggagcaggctcaccagggtgtgttcttcaaccaaggccagtgctgcactgcggggtctcgaatctttgtggaggagtccatctatgaggaatttgtgaaaagaagtgtggaaagagccaagaggcgcattgtggggagcccctttgatcccactactgagcagggtcctcagattgataagaagcaatacaacaaaatcctggagctcatccagagcggtgtggccgagggcgccaagctggagtgtggaggcaaaggactgggaaggaagggcttcttcattgagcctaccgtgttctccaacgttacagatgacatgcggatcgccaaggaggagatttttggaccagtccaggaaattttgaggtttaagactatggatgaagttatagaaagagccaataactcagacttcgggcttgtagcggctgtcttcactaatgacatcaacaaggctctcatggtgtcctctgcaatgcaagctgggacagtttggatcaattgttacaacgccttaaatgctcagagccccttcggggggttcaagatgtctggaaatgggagagaaatgggtgagtttggcttacgggagtactcagaagtaaagaccgtgacggtgaagatcccccagaagaactcctaagaggcccaggccgaagagcaccagtgtgccaagactgccacctatcaccaggcctccttcgtcatgccctgtggcccgcccgacgtcggtttaccactcttgcctcacaacaagtgagcttcagcctgcagaagggagctgtgacgaaagcctgactctccttccttccaaccccacccccttccctctgccttccaatgaaccccattttgtgtgagcagcactggcttccttcccttctctcctgagctgccaaatcgaagccagtctctaacctgggtgaataccatttatttaataatgccaaacataacctaggtgtagaatatggtcatgtatctattgccttctctatttaatggttttttgctttctaaccaaaccagttttcagttttctatttataacctgcctgtccacgatgttttcaagcaagcgctccatactgttactgacaaatgaggacaacgcgctcagcagacagcccctgacatgggctttgagtccttccagcaggcgccctgctcttcctacagcgcacccatgtgaacacacgattaaccagctagctcccttcaacccacagtatagaatgtgaaaaggaagatttatgacttttaatttacttcaaaagaaacctcgtgctagcaataaagcatttatattgtgccggaattc

SEQ ID NO: 2045 - DNA, 1428 bp, Rattus norvegicus
  Genbank Accession No. NM_053897
atgcgaagtctcagcctggcgtggctgctgggaggtatcacccttctggcggcctcggcctcctgcaaccggaccgtgaatgcaccgggacccaacagtaaagggagaagtctgattggcagattggacacgccgcctcccatcactgggaaaggggctccagttgaaccaggcttttccgttgatgaattctctgcatccgtcctcaccgggaagctgaccaccgtctttctcccggtcatctacatcattgtctttgtaattggtttgcccagtaatggtatggccctctgggtcttcttcttccgaacgaagaagaagcaccctgctgtgatttacatggccaacctggccttggcagacctcctctctgtcatctggttccccctgaagatctcctaccacctccatggcaacgactggacctatggggatgcgctctgcaaggtgctcattggctttttctacggcaatatgtactgctccatccttttcatgacctgcctcagcgtgcagaggtactgggtgatcgtgaaccccatgggacactccaggaagagggccaacatcgctgttggcgtctccctggccatctggctcctgatttttctggtcaccatccctctgtacgtcatgaggcagaccatctacattccagccttgaacatcaccacctgtcacgacgtgctgcccgaggaggtcctggtgggggacatgttcagttacttcctctccctggccattggagtctttctgttcccagccctccttactgcgtctgcctacgtgctcatgatcaaaacgctccgctcttccgccatggacgagcactcggagaagaaaaggcggagggctatccgcctcatcatcacggtgctgtccatgtacttcatctgcttcgctcccagcaacgtgctgctcgtcgtgcattatttcctcatcaaaagccagaggcagagccacgtctacgccctctacctcgtcgccctctgcctgtccaccctcaacagctgcatagacccctttgtctactactttgtttcgaaagatttcagggaccaggccagaaacgcgctcctctgccgaagcgtccgcaccgtgaaacgcatgcagatatcgctcacctccaacaagttctccaggaaatccagctcttactcctccagctcaaccagtgttaaaacctcctactgagctgggtctgaggatatggagccagcttgatgatgatgctggtgatgatgatgatgatgatgatggtgatgatgctgatgatgctgatgatgctgatgatgctgatgatgatgatgtatgtgtgtgcaattgtgcgtgcatgcgtgtgtgtgtgtgtgtgtgtgtgtgtgtgtgtgtgttagggatgccaccacaacgcacggggctgtcatttccattccaagttgcactata

SEQ ID NO: 2046 - DNA, 1765 bp, Rattus norvegicus
  Genbank Accession No. NM_053902
ttgaaaaggtactggaaactgaggaccctatctggatcaaagcagtttctgatggagccctcgcctcttgagctaccagttgatgcagtgcggcgcatcgcggctgaactcaattgtgacccaaccgatgagagggtggctctccgcttggatgaggaagataaactgaagcgttttaaggactgtttttatatccccaaaatgcgggacctgccttcaattgatctatctttagtgaatgaggatgataatgccatctatttcctgggaaattcccttggtcttcaaccgaagatggttaaaacatacctggaggaagagctagataagtgggccaaaataggagcctatggccatgaggtagggaaacgtccttggattataggagatgagagcattgtaacccttatgaaggacattgtaggagcccatgagaaagaaatagctctaatgaatgctttgactgttaatttacatctcctgctgttatcattctttaagcctacaccaaagcggcacaaaattcttctagaagccaaagccttcccttctgatcattatgcgatcgagtcacagattcaacttcatggacttgatgttgagaaaagtatgcggatgataaagccacgagagggggaagagaccttaagaatggaggacatactggaagtaattgagaaggaaggagactcaattgctgtggtcctgttcagtggcctgcacttttatactggacagctgttcaacattcctgccattacacaagccggacatgcaaagggctgttttgttggctttgacctagcgcatgcggttggaaatgttgaactccacttacatgactgggatgttgactttgcctgctggtgctcctacaagtatttaaattcaggagctggaggtctggctggtgccttcatccatgagaaacacgctcacacgatcaagccagcgttagtgggatggttcggccatgaactcagtacaagatttaacatggataacaaactacaattaatccccggggtcaatggattccgaatttccaaccctcccattctgttggtctgctccttgcatgccagtttagagatctttcagcaagcaactatgactgcgctgaggagaaaatccattctgctgacaggttatctggaatacttgctcaaacattaccatggcggaaatgacacagaaaacaagaggccagttgtgaacataatcaccccatccagagcagaggaacgaggctgccagctgacactgaccttttccatttccaagaaaggcgtttttaaggaactagaaaaaagaggagtcgtctgtgacaagcgagaaccagaaggcatccgggtggccccggttcctctctataattctttccatgatgtttataagttcatcagactgcttactgccatactcgactctacagaaagaaactagccatgctttctaaataactcaagtaaatctcacacactgggggttccacttctactgcattttagtcattcaaaagtctccagaaattgatggcatagaaatgatgatgattttataaacttacataaaacctggtacatgttttaatatctgtgtcgctgatgtgctgtggactaagaagtcacattttacatgactccaacctacagatgactgtcttgatcagctgtcaccttccatggtcactgaaaggttgtgtgtttaatttgtgactgaaatgacaacattaaaatgtatctggacttcttgtataaaaaaa

SEQ ID NO: 2047 - DNA, 1561 bp, Rattus norvegicus
  Genbank Accession No. NM_053911
gcgggccccaccggccgggcggttgggccgtgaagggagagtcttttcggcgctgaggacgggcgctgaggaggcggcggtggctcctggggcgtttgagcgggctcactcgagcccgcgggccgacgcggacgcaggcccagccggcggaaacgccccggactccccgcgggccttcctagccgccatggaggacggtgtctacgagcccccagacttgactccagaggagcgcatggagctggagaacatccgtcggcgaaagcaggagctgctggtggagatccagcgcctccgggaagagctaagtgaagctatgagcgaagtggagggtctggaggccaatgagggcagtaagaccttgcagcggaaccggaagatggcaatgggccggaagaaattcaacatggaccccaaaaaggggatccaattcttggtggagcatgaacttctacagaacacacctgaggaaattgcccgcttcctgtacaagggcgaggggctgaacaagacagccattggggactacctaggggaaagggaagagctgaacctgtctgtgctccatgcttttgtggatctacatgagttcaccgacctcaatctggttcaggccctccggcaattcctgtggagctttcgcctccctggagaggctcagaaaattgaccgaatgatggaggcctttgcccagagatattgcttatgtaatcccggggtcttccagtccacagacacctgctacgtgttgtccttcgctgtgatcatgctgaacaccagccttcacaatcccaatgtcagggacaagccgggcctggagcgctttgtggccatgaaccgaggcatcaatgagggtggggacctgcctgaggaccttctcaggaacctctatgacagcatccgaaacgagcccttcaaaatccctgaggatgatgggaatgatctcacccacaccttcttcaacccagaccgagagggctggctcctaaagctgggagggggccgggtgaagacttggaagcgtcgctggttcatcctcacagacaactgcctctactactttgagtacactacggacaaggagcccagagggatcatccccctagagaacctgagcattcgtgaggtggatgatcctcggaagccgaactgctttgagctttacattcccaacaataagggacagctcatcaaagcctgcaaaacggaggctgatggtcgggtagtagaggggaaccacatggtgtaccgaatctcagcacccacacaggaggagaaagacgagtggatcaagtccatccaggctgctgtaagcgtggaccccttctacgagatgttggcagcaagaaagaagcggatttctgtgaagaagaagcaagaacaaccctgaccctgtccccaactccattatttattttggagctgccccgcctgggtggcaggacccctgggccctggggctgtggatcctggttccctgtttggaaaatcaccacctctagctcctgactccttatttgtaattaacatgttggtaatcttattaattatttaacccctc

SEQ ID NO: 2048 - DNA, 4543 bp, Rattus norvegicus
  Genbank Accession No. NM_053927
gccgagcaggacgccagcgccagcccggtccccacgccgcggcgcgcccggccttcgcgtctcccccagaacaatcaaccatgacaaccgaatcaggatcagactcagaatccaagccagaccaggaggctgagccccaggaggcagcaggacctcaggagcaagcaggggcacaggctgcacctgagcctgctggcggaaacgtcgaggagcagccaggactagagcagttccctgaagctgctgcacacagcacgccggtgaagagggaggtcagcgacaaagaccgggacttcgccgccgcagctgcgaaacagcttgagtatcagcagtttgaggacgataagctctctcagaagtcatccagcagcaaactctcacggtccccattgaagatcgtgaaaaggcctaaaagcatgcagtgcaaagtgacgcttctggatggatctgagtacggctgtgatgtagataagcgctcccgaggacaagtgctgtttgacaaagtgtgcgaacatctgaacttgctagaaaaagactacttcggtctcacgtatcgagacgcagagaatcagaagaactggttggaccctgctaaggaaattaaaaagcagattcgaagtggtgcttggcatttttcatttaatgtgaagttttacccaccagaccctgcccagctatcagaagatatcaccaggtactacctctgcttgcagctgcgagatgatattgtgtctggacgcctaccctgttccttcgtgaccctcgccctgctgggctcctacacagtgcagtcagagcttggggactatgatcctgatgaatgtggaaatgactacattagcgagttccgctttgcgccaaaccacacgaaagaactggaggataaagtgatcgagctgcacaagagccacagaggaatgacgccagccgaggcagagatgcacttcctggagaatgccaaaaagctctccatgtatggggtagacttacaccacgcaaaggattcggaaggcgtggagatcatgttaggggtctgtgccagcggcctgttgatctatcgtgaccggcttcgaataaacagatttgcttggcccaaggtcctaaaaatttcttataaacggaacaacttttacattaaaatccggccaggagagtttgaacaattcgaaagcaccattggcttcaagttgccgaaccatagggctgccaagcgcctctggaaagtatgtgtggaacatcatacatttttcagactactgctaccagaagcacctccaaagaaattcctgaccttgggctccaagttccgctacagtggcagaacccaggcgcagacgagaagagccagtgcattgatagaccgcccggcgccttacttcgaacgctcgtccagcaaacgatacaccatgtctcgcagcttggatggagcctcagtgaatgaaaaccatgaaatatacatgaaggattctatgtctgctgcagaggttggtacaggccagtacgccacaaccaaggtcatctctcagaccaacctgatcaccactgtgaccccggagaaaaaggctgaggaggagcacgtggaggaagaggacagaaggaagaaggccgaggaagccacgcccgtcgcagccctccggcacgagggaaagtcaccagggcatggctctgactcatgtcccctgtcacctccatcagcccatcttgaccctccctctcccacagagctccgtaggaggtgcaaggagaaagaaagggcctctccaggttctgctgtgcctagagcagagctgtcctcggagtctgatgcccaggggaaggcctacctaggggaccaagatgtggcatttagttacaggcagccggctggcaaaggaaccacactgttttccttctccttgcagctcccagagtcattcccctcgctcctagatgaagacgggtacctctctttccccaacctgtctgaaaccaacctcctgccccagagttggcagcatttcttgcccatccgctcgccctccctccttccctgcttcctcttcatcttcttcttcctgctgtctgcctccttctcagtaccatacgccctcactctctccttccctctggctctgtgcctctgcttcctggagcccaaggcggcctccttgagcgcctccctagacaatgacccgagtgacagttcagaggaagagactgacagtgagcggacagacactgcggctgatggagagaccagtgccacagagtcggaccaggaggaagacgcagagctcaaggcacaggagctagataaaactcaagatgagctggtgaaacaccaaaccaatattagcgaactgaaaagaaccttcttagaaacctctacagaaactgccttaacaaacgaatgggaaaagaggctctccacatcccccgtgcggctggctgccaggcaggaggatgcgcccatgattgagccacttgtacctgaggagactaaacaatcttctggggagaagctcatggatggctcggagatcctcagtctattagagtctgcgaggaaacccacagagttcataggaggggtttcatctactacccagagctgggtgcagaaactggaaacgaagactgagaccattgaaacagaggtggaacccaccccacaccctcagcccctcagcacggagaaggtgttgcaggaaacggtgctggtagaggagaggcacgtgatgaacgtgcacgccagtggggacgcttctcacacagccagggatgatgtggatgccacagaatcagcacccgcagaccgtcacagtgggaatgggaaggagggctcttctgtgacagaagcagctaaggaacagagaggagaggaggctgacaagtctgccccggagcaggaacaaccagccactgtctcccaggaggaggatcaggtgtcggccatccactcttctgagggtttggaacaaaagtctcattttgagtcgtccactgtgaaggtagaaagcataagtgtgggcagtgtctctccaggaggagtgaagctagagacctctaccaaggaggtgccagtggtccacacagagacgaaaaccatcacgtacgagtcttctcaggtcgatcctggggcagatctggagccaggtgtgctaatgagcgcccaaacgatcacgtctgaaaccacgagtactaccaccaccacacatatcaccaaaactgtgaaaggaggcatttcggagacgaggattgagaagcgaatagtcatcacgggagatgccgacattgaccatgaccaggcgctggctcaggcaattaaagaggccaaagagcagcaccccgacatgtcagtaaccaaagtagtggtccataaagagacagaaatcacaccagaagatggagaggattgaccgcaggaataactcagctagcacgtgaacccagtcgtgtaagccgtcaggaaaaccggagcctatgtgggattccctcttctaacccaactgactcataaccgtccgtggaaaattccgatccaggaaagctgactttgaccgttagatgaaagaccctggcagagagatcttcccataataaagcaatccaaaatcagcatcattaaactgatactgcatgaagcaacgataaaaaaaaatcacaaaggagcagcacttttaattttcaccaaaatatctccgttttcaactctacctgcacgttcataaccaacagtgtaagccgtgatctcatgtaacccatcgacaactcatgcctttcctagtttattattaaaagtctcaacaaagttgcagtttcatagatgacaaattctctgtttacaataaatggtaatcaccctacaatgctgtcagccgtctaggtccttctggtgtgtcagatttaccccagattagatgtgccaataaccaaccttatccagtaaacaacttgaatcgtgtccttgtctaatctggttttgttattctcgcccataagcagttacaactctctgaccctctagaaatgtttaatgcttacaaaccttgctttatgtctctaatttgctgtaaggtagcattggttttagcacactgatgtggtttcttcttccacacttgctctggtctctattcgacccagaaagattcccagaattacctaagcaaaccctcaataatgtaaattatcatttgtgtgggaagaaaatacatattttttgttagtttataatattatgaaaattcactccagggaatacctgtctggctacctttactttctgttcttttttctttttcattgattttttttttcttcttttacttgaacaaaaaggtgttttatttacaaatctggtccatacttacaatctagttcagaaccaagccttaaattgtacagaatttccactgtaattaaaatatttagtgttcagttataaatagcctccagaaagatatattgtccactacactgtcaactgcatcacagcccgtcgtgaatgatgtcaccgcatcgcgaaataaaaatggcaaatgcattgaaaaaaaaaaaaaaa

SEQ ID NO: 2049 - DNA, 908 bp, Rattus norvegicus
  Genbank Accession No. NM_053930
aacgaagtaggcctccatcctctcgccatgggctcccggccgcgcggggcgctgagcctgctgcttctgctgctagcgccgcccagccgcccagcctctggctgtcccgcgccatgccgctgctctgagacgcgcgtggactgcgggcgccgcgggctgacctgggcctcgctgccggctgccttccctcccgacactacagaattggtgctgaccgacaacaacctgacggcgctgccgcccgggcttctggatacgctgccggcgctgcgcagagtgcacctgggcgctaacccatggcgctgcgactgtcgcttattgccgctgcgcgcctggctggccggccgccctgagcgcgagttctaccgcgacctgcgctgtgtcgcgcctctggcgctgcgtggccgcttgctgccctacgtggcggaggatgagctgcgggccgcatgcgcgcccggcctactttgctggggagctctggtggcgcagctagcgctgctggtcctcgggctgctacacgcgctgctgctggcactcctactgagtcgcctgcggaggctacgcgcgcaggcgcgcgctcgctccacccgcgagttctcactcacagccccgctggtggccgagtcggccggaggtggtgcatcttaagaaaggacaggcgcagagcaacgacgacctgcaaattttacaggtccctgctggaggaccctccgccttcacctggatcggccttggcctctatccttgcccaacttcccagacccaagctctgcaagcctgaatccacatggggtcaaactgctgccagtactaccagaatgaggcaaccttgagtcttcagagcctagagtgctggagcagtccagtctcctgccagactccgcactgaataaacctttctcctcctc

SEQ ID NO: 2050 - DNA, 1543 bp, Rattus norvegicus
  Genbank Accession No. NM_053936
cacgagcagccgccccgcgtctcctgccctttggccaggctttcagttcctcctagcatgactgagatctgaccagccgactcacgagttgcttcttgtgccaccactgcagtgctggggcctcttcatcgctccaaactacagcactgtcatggcagctgcctctacttccagccctgtgatttcacagccccagttcacagccatgaacgaacaacagtgcttctacaacgagtctatcgccttcttctataaccggagtggaaagtatctagccacagaatggaacactgtgagcaagctggtgatgggactgggcatcactgtctgcgtgttcatcatgctggccaatctactggtcatggtggcaatttacgtcaaccgccgcttccatttccctatttattacttgatggccaacctggctgctgcagacttcttcgctggactggcctacttctacctgatgttcaacacgggacctaatacccggagactgaccgtgagcacatggcttctccggcagggcctcatcgacaccagcctgacggcttctgtggccaacctgctggccattgccatcgagaggcacatcacagttttccgaatgcagctccatacacgaatgagcaaccgacgtgtggtggtggtgattgtagtcatctggactatggccattgtgatgggtgccatacccagtgtgggctggaactgcatctgtgatatcgatcattgttccaacatggcgcccctctacagtgactcctacttagtcttctgggccattttcaacctggtgacctttgtggtcatggtggttctctacgctcacatctttggctatgttcgccagaggactatgagaatgtcccggcatagttctggacccaggaggaatcgggacaccatgatgagccttctgaagactgtggtcattgtgctgggtgcctttattgtctgctggactccgggattggtcttgctactgctcgatgtgtgttgcccgcagtgcgatgtcctggcctatgagaagttcttcctcctcctggccgagttcaactctgctatgaaccccatcatctactcctaccgcgacaaagagatgagcgccaccttcaggcagatcctgtgttgccagcgcaacgagaaccccaacggccccacggaaggctctgaccgctcggcctcctccctcaaccacactattctggctggagttcacagcaatgaccactctgtggtttagaaggaagccagccggcctttgtggatttgtgaaccccaccctacccgcattgccagggcaaggtggggcgccagaggagacgaagacactcctgtacttaacactaaccaatggcagtatttgtccctagacccaagagactttaggatgaacttgcttggtagcccccatcttctcctttggaaaagagaaggggaccgtcttgcagtggaattcagaaacggactctggggagaccgtgtatgtagccttcactaactagacttaaaagattttatgtggtttggcctaagccag

SEQ ID NO: 2051 - DNA, 1227 bp, Rattus norvegicus
  Genbank Accession No. NM_053955
ggcacgagcgggttcgaaggcaggcggcgagatgaggcgggcgccagcgtttctgagcgccgacgaggtgcaggaccacctccgcagctccagcctcctcatcccgcccctggaggccgcactggccaacttctccaaaggtcccgacggaggggtcatgcaaccggtgcgcaccgtggtgcctgtggccaagcaccgaggcttcttgggagtcatgccagcctacagtgccgctgaggatgcactcaccaccaagttagtcaccttctatgagggccacagcaacaatgctgtcccctcccaccaggcatcagtgcttctctttgatcccagcaatggttccctgctggcggtcatggatggaaatgtcataactgcaaagaggacagcagccgtctctgccatcgccaccaagtttttgaagcccccaggcagtgatgtgctgtgcattcttggggctggggtccaggcgtacagtcactatgagatcttcacagaacagttctccttcaaggaggtgagaatgtggaaccgcaccagggaaaatgctgagaagtttgcaagctcagtgcaaggagatgttcgggtctgttcatcagtgcaggaggctgtgacaggtgccgatgtcatcatcacagtcaccatggcaacggagcccattttgtttggtgaatgggtgaagcccggagctcacatcaatgctgttggagccagtagacctgactggcgagaactggatgacgagctcatgaagcaagcagtgttgtatgtggactcccgggaggctgccctaaaggagtcaggagatgttctgttgtcaggggctgacatctttgctgagcttggagaagtggtttcaggagcgaagcctgcatactgtgagaagaccacggtgttcaagtctttggggatggcagtggaggacctggtcgcagccaaattagtgtacgattcgtggtcatctggcaagtgagcagaaggagctgtgcctgagctggatggacgtcacggctcaaacgctggctcagtgtctagatcaaaggaggcctagtccccagtgaacgggagtgagagtcactcataagtattgacatccctattcatgtttgtggttggatagctaaacccttctgttagggggtgatggccacattacctacccttgatcttactagccttgtgtgtctctgaaataaatcatttccagttcaaaaaaaaaaaaaaaaa

SEQ ID NO: 2052 - DNA, 4529 bp, Rattus norvegicus
  Genbank Accession No. NM_053961
aagcttcttgatttcacttttcttcagtcacaaacttgaggatggagctttaagagtatacacatggcctactattcggctatcacccaggcccagcttaggctctttttaaaaaaaagtcatttttttttaagatttatttattttatgtctatgagtacactgtagctgtcttcagacacaccagaagagggcatcagatctcattacagatggttgtgagccaccatgtggttgctgggaattgaactcaggacctctggaagagtagttgggtgctcttaaccgctgagccatctctccagccccccctttttttaaaaatatatttattgtatatatgtgagcacactgttaccatattcagacacaccagaagagggcatctgatcccttacagatggtcgtgagccaccatgtggatgctggggattgaactcaggacctctggaagagcaaccagtgttcttaaccactgaaccatctctccagtccatctgtatggctttcttttttttggttctttttttttttttcggagctggggaccaaacccagggccttgcgcttcctaggcaagcgctctaccactgagctaaatccccaaccccctgtatggctttcttaattgccagattttaacttcttctctcacctcctctaactactgcaatagatactcaactgcgctcagcctcagtcttctcccttctgatgcattctcttcattcattatccttttttatagtgagaaaaggttgctctataaagtccaggctgacctgagactaaattggccgtgctggcttcccattcacagagacccaccggcctcagctgagtgctggggtcaaaggctctagccatcatgcccagctgcaatgtcttttcttaaagggacatcaggcccgctggattggggcctgcctgtaggaggtcacttagctttaattatttctctaattactacaattatctctctaaatgcaattgtagtgcatctgaggcacgtgatttaatctgtgttatcccaaagtcctcttcaggtttcctcaggtctccagtgctctccttcccaggaaggcttggaactaaagccacatcatggtttttttgttttttttttctttttttcggagctgagctggggaccgaacccagggccttgcacttcctaggcaagcgctctaccactgagctaaatccccaaccccccacatcatgtttacgtgatgttttcatccacgaatctgagaaaacgctccacttaaagcctctggtggctgtaaaccccttgagactagtgagtctttatcttaccctcctgagtttgcctttacatagcttcatagagctcagcatgcttaaccatatcctgtttcccgttgcttcacaaatgttccctacctttcaaagtcatggctccccaactacctgggtacctcgatgacacgagtaagcaggactgactcgtaatacaggatcttcaaaggtggaaagccatgagatgggagtgaagattttaacacttaactgggtagatgggagccctggagaccacactcacaactcaaaaaggtaaggaggacatacaggtcttttttgggacatagccatgtgacactgtgacagaatgaccagtgtgtcatacttgcacagcctgtgtagaggtcaaggtcagtatggctggtcaaatggagggcagctagctgcctattagaggggcggtcattaggcgacaactgtaaaaagcacagctgaaggactgatcgctcctagggatggtggaggaggaattttattgtagataaaagggagagagcatagtcagagcaaagacggctgggagagtcagaggggcagcctgggttaagacactgacgaagagagtgccatagctaaaatggctggattatataaggaaaggcagctggacgaagggcagtccagaccttgggttggggaagtttagggtggggagcagggcatgcctgccataccctgaaggattctgggaaaacctcatggccaggtccactttgatgttagtcacctcagtttgtcccagggtttcagacttaacagtaataagaaagatagaaagtgcccgacataatccagctttggtttcatgattctacaggtgtgtgtgtgtgtgtgtgtgtgtgtgtgtgtgtgtgtgtgtgtgtgggtgtgtgtgtgcgtgcatatagaggtcactgattaagctcaatttggtgatcttcctcgcttccccagtactggcaagaattccacacccagctttttatgttttgtttttgtcattttgagacccaggttgactctgaagggcctagacctcactctgtagaccaggttggccttgaactcaggttcaccagccttggacttaggagtggtaagatgtgcttttcccttgggtgctgaggatgggacttatatgtgatgtgtacgagtcctggaacagggtatgtggatcagattttgatcagcctgccagttttccagtgagcactgggattgaaggcctgtgctgcctcacacagcctgctagctatgatccctgtgtcttctccagtgaggaattcattccttcgagcctttatcactgtgctgacttcccacgggaacaatcatcacgtggcatgagctactccctgaaaacggaacagcccagcctggtcttgtcaccctcctgccttgtgctgaaattaggcctgtaggcctgtgccacctactatacctgaccaaaagtagaatggcgaataggccttttcccaaccttctggggcaggggtggccccattgcctaagtgccccgcgggcctgtccagcgctgcaccctgtgacctacaagggcttggcagcgactaccagtgacaaacagctgactaaccgggggaagcgacgggtctcaacggacctcatgacagcccagcgcagagaaggcagggacgccgccacgtcttgttccaaggcgagagagggcaacgagggaattgttgaggctgcgcctcgcgcctctcctcacgcgagaacgccgcgaaacccagcctagacgagtggcacggagtgcgcgtgcgcgacagtcccacttcgcaggcccttccgtcacgtggccccagcccacctccccccacctcccccccaccgtgcccccgcttctctcactacacatgcgcagccgcccctctctgccccgcccctctgcggccggtctcttccaccctagaggccgcctgagcctctccgagtggccacgtgcgctcatgcgcgccggcgggacggccctcccagtgacgtgaccgcccactcggagcgctcctgctgtagcttgcccatctcccgctcccacaatccggcgtgatggctgccgccgttcctggcgccgtttcgctctccccactgctgtccgttctccttggcctgctgctcctctctgctcctcatggcgccagcggcctgcacacgaagggcgcccttcccttggacacagtcactttctacaaggtcattcccaaaagcaagttcgtcttggtgaagttcgacacccagtacccctatggagagaagcaagatgagtttaagcgtctggctgagaactcagcctccagcgatgatctcttggtggcagaggtggggatctcagactatggtgacaagctgaacatggagctgagtgagaagtacaagctggacaaagagagctacccagtcttctacctcttccgggatggggactttgagaatcctgtcccatacagcggggcagttaaagttggagccatccagcgctggctcaaggggcagggagtctatctgggcatgcctggatgtctgcctgcgtacgatgccctggcgggccagttcatcgaggcctccagcagagaggcccgccaggccatcctgaaacaggggcaggatggcctctcaggtgtgaaggagacagacaagaagtgggccagtcagtacctgaagatcatggggaagatcttggaccaaggtgaagacttcccggcctccgagctggcccggatcagtaagctcattgagaacaagatgagtgagggtaagaaggaagagctgcagaggagcctcaacatcctcaccgccttccgcaagaaaggcgccgagaaggaggagctgtgagggcaccaggctgctagggtttgctgagggcggggagggagagccgcctgctgactgtggggccctgtgggtggagggggcagtggagcaaagcagtcctgagccagagacctgtgccccgagtgcctggacactgaggctgctgagaccataccctggacatccttggagcagtttgtggggagcctgtgtgccaagacaagatggctgtgtcccacaggagctggtactatagaggaaggtccttgacaggtatagttctgatcaaataaaagtctgttttggttagatgattttcttctcagatagtactttttggcccctgtcaagagtctgagctgttgtgcattctattctgccaagacttgcctgcgtaa

SEQ ID NO: 2053 - DNA, 1288 bp, Rattus norvegicus
  Genbank Accession No. NM_053962
actttccactctcccaggacacagacaaaatctacccttctcgctcgctctgtccagctcctcctgtgccgggtgcggcggggcatacctgtgatcccagcaattgggagactgagacaggaggatccaaccttcaaagctacatgccatggctgcccaggagtccctgcacgtgaagaccccactacgtgacagcatggcattgtccaaagtggccggcactagtgtgttccttaagatggacagctctcagccctctggctccttcaagatccgaggcattgggcatctctgcaagatgaaggcaaaacaaggctgtaaacatttcgtctgctcttcagcgggcaacgcgggcatggcgactgcctatgctgccaggaggctgggcctcccagccactattgttgtgccaagcaccacacctgccctcaccattgagcggctgaagaacgaaggggccacagttgaagtggtgggagagatgctggatgaggccatccaactggccaaggctctggaaaagaacaacccaggttgggtgtacatctcccccttcgatgaccctctcatctgggaaggccacacttcccttgtgaaggagctgaaggagacactgagcgccaagcccggggccattgtgctgtctgtgggcggtggaggcctgctgtgcggagtggtccaggggctgcgggaggtgggctgggaggatgtgcccatcatcgccatggagaccttcggcgcccacagcttccacgctgccgtcaaggaaggaaagctggtcaccctgcccaagatcaccagtgttgccaaggccttgggtgtgaacactgtgggggcacagaccctgaagctgttttacgaacaccccattttctctgaggtcatctcagaccaggaggctgtgactgctatcgagaagttcgtagacgatgagaagatcctggtggagcccgcgtgtggcgctgccctggctgcagtgtacagcggtgtggtgtgcaggctgcaggctgaggcccgactgcaaaccccactggcctcgctggttgtcattgtgtgtggtggcagcaacatcagcctggcacagctgcaggcactcaaggcacagctgggcctgaatgagctactcaagtgatatctgctgctgccctggccaccctgaggggtcaccagcacccctgagtaggctgggtgggcgtccgcctgacagtggcccaccctcctttatccatgtttataatatgcactttttcattgtaaataaaaattaatatatatatgtttataaagc

SEQ ID NO: 2054 - DNA, 2116 bp, Rattus norvegicus
  Genbank Accession No. NM_053967
ctggagtcctctgtagaccttgccttggtctaggtcgcttgagtagatttaggttgaccatgactcacatgaattaagattttcttttgttatgatggagatgcagatggtaggcaagtgattctaagtttccagcaagttctggatgttttaacttgccgcaagatattcctgaaacgtaacacaagaagaagaatcttctgtgtaaattagtcacatactttattctcccacatgtcacaatccttctaatctattgcatcaaattctggacagactgaagtatataagaagaaataagtgcttacatagtaattattctccgtaatgggagagttgcaatttaagtggctcttttggaggagctttgctgagtctgggggcacattccaaacagtgttaatctttcttttcattccatattccttgactgtggattatagggcaacaccagttctgtcagatacaactttcgtttgggtctggaatgttccaactgaagcttgtgtagaaaacgttactgaaccaatagatctgagcttcttctctttaattggaagcccccggaaaactgccatagggcagcctgtcacattattttatgttgatcgacttggtaactatcctcacatagatgcacagcaaacagaacatcatggaggaatacctcagaagggggatttgacaactcatttggtgaaagctaaggaagacgtagagcgttacataccaacagacaaactgggtttagctatcattgactgggaagaatggaggcctacctggatgagaaactggacacctaaggatatttacaggaataagtctattgaattggtccaggcagctgatccagcaattaatatcacagaagctactgtgagagccaaagcacaatttgaaggggcagctaaagagtttatggaagggactttaaaattggggaaacatattcgaccaaagcacttatggggtttttatctatttcctgattgttataacaataaatttcaagtcgataactatgatggccaatgccctgatgtggaaaagaaacgaaacgatgatcttgactggctatggaaagaaagcacgggcctttacccatctgtctatttgaagaaagatttgaagtcgagtcgaaaagcaaccctttatgtccgctaccgagttttagaatctatcagagtgtccaaagtttcagatgaatcgaatccagttccaatttttgtctatatccgtcttgttttcactgatcatgtctctgaataccttctagaggatgatcttgtgaatacaattggtgaaattgttgctcagggtacctctggaattataatatgggatgctatgtctttagcacaacgttcggcaggttgcccaatcctacgtcaatacatgaagacaaccctgaatccatacatagtcaatgtcaccctagcagccaaaatgtgcagtcaaacactttgtaaggagaaaggcatgtgttcgagaaaaacagaaagttcagatgcatatcttcacttggatccaagtagtttttctattaatgtaacagaagctggaaagtatgaagttcttggcaagcccgaggttaaagacttggaatacttttctgaacattttaaatgcagctgttttagcaaaatgacatgtgaggagacatctgatatgcgaagtatacaagatgtgaatgtgtgcatgggtgacaatgtttgtataaaagccacgctaggacccaactcagcattccacctcctacctggcaaaggcctcctccttatgacaacacttgctcacatcttgcaccatctaccacatgatatttttgtttttccgtggaagatgctagtcagtactccttagttttctctatccagagcatttgctatattatttttttgcaggcctcggtaatttgggattatgaatgtgattctattttgcaaaagcaattcaattttaataatcaagattctatttttgagtttcaaagacaaattatatactcttccaccaaagactgattgcaagcaaggctactgaacttagagattattttttgtttaaagagaatgaaaactgaataaaataactaactataaaaaaaaaaaaa

SEQ ID NO: 2055 - DNA, 963 bp, Rattus norvegicus
  Genbank Accession No. NM_053971
ctctttcccgtcttgcaagatggcgggtgaaaaggcggagaagcctgataaaaaggagcagaaacctgcagccaagaaggctggcggtgatgctactgcgccccgcgccggggcctggtgcgtcaaaaagagtagttctaaggctaaaaagctgaggaagagtaagccccattgcagccggaaccctgtcctggtgagaggaatcggcaggtattcccgatctgctatgtattccagaaaggccttgtacaaaaggaaatactctgctgccaagacaaaggttgagaagaagaagaagaaagaaaaggtccttgctaccgtcacaaaaacagttggtggggacaagaacggtggcacccgggtggtgaagcttcgaaaaatgcctaggtattaccctactgaagacgtgcctcggaagctgctgagccacggcaagaagcccttcagccagcacgtgaggcggctgcgctccagcatcactcccgggactgtcctgatcatcctcactgggcgccacaggggcaagagagtggttttcctcaagcagctgggcagtggcttgctacttgtgactggacctcttgccctcaacagagttcctctgcgtaggacacaccagaagtttgtcatcgccacctctacgaaagttgatatcagcaaggttaaaattcccaaacacctgactgatgcttacttcaagaagaagccacttcgcaagcccaggcatcaggagggtgagatcttcgacacagagaaggagaaatacgaaattacagagcagcgaaaggctgatcagaaagctgtggactcgcagattttgccaaagatcaaagctgtcccccagctccagggctacctgcggtctcagttctccctgacgaacggcatgtaccctcacaaactggtgttctaattgttaacaacctaattaaactgcttcataaggaaaaaaaaaaaaaaaaa

SEQ ID NO: 2056 - DNA, 1647 bp, Rattus norvegicus
  Genbank Accession No. NM_053974
cctctcgcccccccttcaggagcggttgtgcgatcagatcgatctaagatggcgactgtggaaccggaaaccacccctaccactaatcccccacctgcggaagaggaaaaaacagagtctaatcaggaggttgctaatccagagcactatattaaacaccctctacagaacaggtgggcactctggttttttaaaaatgataaaagcaaaacttggcaagcaaaccttcggttgatctctaagtttgatactgttgaagacttttgggctctatacaaccatatccagttgtctagtaatttaatgcctggctgtgactactcactttttaaggatggtattgagcctatgtgggaagatgagaaaaacaaacggggaggacgatggctaattacattgaacaagcagcagagacgaagtgacctcgatcgcttttggctagagacactgctgtgccttattggagaatcttttgatgactacagtgatgacgtgtgtggagctgttgtcaatgttagagctaaaggtgataagatagcaatatggacgactgaatgtgaaaacagagatgcagtcacacacatagggagggtatacaaggaaaggttaggacttcctccgaagatagtgattggttatcagtcccacgcagacacagctacaaagagcggctccaccactaaaaataggtttgttgtttaagaagacaccttctgagtatcctcacaggagactgcgtcacgcaatcgagattgggagctgaaccaaagcctcatcaaagcagagtggactgcactgaagctgactccatccaagtgttgctaagatataagagaagtctcattcgcctttgtcttgtacttctgtgttcattctcctccccaccccaatttttgctagtgtgtccacatcccaatcaaagaattacagtatacgtcaccccagaacccacagatgtgttcctggcccgctctgtaacagccgggtagagttaccacgacacacacttgcctttccacagtattcgaaaaagaacgtgcatttctgtcaccttagcaggaaaagatctggttttgttccactccatgcaggagcggatttgctggtgtgagagtctaagtacagctttctagcaaccttctgttttctgtcacagcattgtccttgctgtcctcttgctgatggctgctagatgttaatttatttgcttccctccttgataacattagtgattctgatttcaggtttttcatttgtttggcttttgtttttttcctcatgtaacattggtgaaggatccaggactatgacagaaaggtggaataaacattacatttgtgcattctttggtaagtttttttgttttttgtaactacaaagctttgctacaaatttatgcatttcattcaaatcagtgatctatgctgtgtgatccctaaacataattgtggactataaaaatgtaacaccataattacattcctaactagaattagttgtctgcttttgtatctttatgctgtactttaacactttgtattacttaggttattttgctttggttacaatggctcaagtagaaaagcggtcccatccatattaagacagtgtacaaaactgtaaataaaatgtgtacagtgaattgtc

SEQ ID NO: 2057 - DNA, 943 bp, Rattus norvegicus
  Genbank Accession No. NM_053980
actccgcccgtgctgggtctgtcgatcctcgttccgtcaaggaccgtgaaggggtcaacgtgaggtcggtggggttagtaacgcggtggcggcggctcctcctccaaaatttgagcaggtacagggtgccaaacaggatgtacacgctgctttccgggctgtacaagtacatgttccagaaggatgaatactgcatcctgatcctgggcctggacaatgctgggaagacgaccttcctggaacagtcaaaaacacgatttaacaagaactacaagggaatgagtctatccaaaatcaccactaccgtgggtctaaacattggcactgtggacgtaggaaaggctcgtctcatgttttgggacttaggtgggcaggaagagctgcagtcgttgtgggacaagtactatgcagagtgccatggtgtcatctatgtcattgattccactgatgaggagaggctgtcagaatcaaaagaggcatttgagaaggtggtttcgagtgaagcactggacggtgttcccatcctggtgttggccaacaagcaggatgtggagacttgcctctccattcctgacatcaagactgcattcagtgactgtacctgcaagattggcaggcgagattgtttgacccaggcctgctctgccctcacaggcaagggagttcgagagggcatcgaatggatggtgaagtgtgtcgtacggaatgttcaccggccaccacggcagagggacatcacataagcaccttcatcctcacagtcttggactgttcatcccctagtgttggaagagtattctctgctggcttctgtcctcctgatgctgggggttgagctgggtttgtctgttcatttttatttgctttatgttttctctaagacaaacttttctctgtgtctggaaaagtgtaggtattcagagacaaaaaaaaaaaaaaaaaa

SEQ ID NO: 2058 - DNA, 449 bp, Rattus norvegicus
  Genbank Accession No. NM_053982
accgtcaccatggtgcgaatgaatgttctggcagatgctctcaagagcatcaacaacgcggagaagaggggcaaacgccaggtcctcatcaggccgtgttccaaagtcatcgttcggttcctaactgtgatgatgaagcatggctacattggtgaattcgagatcattgatgatcacagagctgggaagattgttgtgaacctcacaggaaggttgaacaagtgtggagttataagccctagatttgatgttcaactcaaagacctagagaagtggcagaacaatctgctcccatcacggcagtttggtttcattgtgctgacgacctcggctggcatcatggaccatgaagaggcaagacgaaaacatacaggagggaaaatcctgggattctttttttaaatgtaaagcataaataaaaagcctctgtggactgtgaaaaaaaaaaa

SEQ ID NO: 2059 - DNA, 1107 bp, Rattus norvegicus
  Genbank Accession No. NM_053985
agcggtttggtcgttcgttggaggagcttcgtcttgttctgctctgcgattgcggcgcttgttcgagcgcttacagcggcgcgtcggtcccagcaagggcctcagacttcagctttgggtgagagaagatggcccgaaccaagcagaccgctaggaagtccaccggagggaaagccccccgcaaacagctggccaccaaggcggcccggaaaagcgcgccctctactggcggggtgaagaaacctcatcgctacaggcccgggaccgtggctctaagagagatccgtcgttaccagaaatcgactgagctgctcatccggaagctacccttccagaggttggtgagggagatcgcccaggatttcaaaaccgacttgaggtttcaaagtgcagccatcggtgcccttcaggaggctagcgaggcatacctggtggggttgtttgaagataccaatctgtgtgccatccacgccaagagagtcaccatcatgcccaaagacatccagttggctcgccggatacggggggagagagcttaagttgaagcgatttttatggcattttgtagtaaattctgtaaaatactttggtttaatttgtgactttttttgtaagaaattgtttataatatgttgcatttgtacttaagtcattccatctttcactcaggatgaatggaaagagtgactgttcacagacctcagtgatgtgagcactgtggctcaggagtgacaagttgctaatatgcagaagggatgggtgatacttcttgcttctcatgatgcatgtttctgtatgttaatgacttgttgggtagctattaaggtactagaattgataaatgtgtacagggtccttttgcaataaaactggttatgacttgatccaagtgtttaaccatacatcactgtgatagaatgtgggctttttcaaaggttgaagatacaagttttagccacagtgtaacagtttcctttaaaaaaaaaaaagtaaacctggcagctatagaatacactatgtgcatttataatagctattttatatattgtagtgttcaacatttttaaattaaatgttttacattcacaaaaaaaaaaaaaaaaaaaa

SEQ ID NO: 2060 - DNA, 1938 bp, Rattus norvegicus
  Genbank Accession No. NM_054001
ggccaggcgatcccagcacccgcgatcgcgcgctctgtgctccgagggccgtgctcgcctggtgcctactccagggctgtgtacaccgcgtcgggctcggctgagcccgcaccaggagggcgcgggagccgcagggccctggagctttgggcgactgctacgcggccttggccgaggctcttccttgctcgccgttctgtcgcgggcctggcccgtgaaccgctcacagtatggcccgatgctgcttctacacggcggggacactgtctctgctgctgctggtgaccagtgtcacgctgctagtggctcgagtctttcagaaggcagtggaccagacgatcgagaagaatatggtattacaaaatggtaccaaggtctttgattcctgggagaagccccctctacctgtgtacatccagttttatttcttcaatgtcaccaatccagaggagatcctccaaggagaaatccccctgctagaagaagtggggccgtacacctacagggagctcaggaacaaggcaaacgttcagtttggagaaaatggaacaaccatatctgccgtcaccaataaggcatatatttttgaacgaaaccagtctgttggagaccctaccgttgacttgattagaacaataaatattcctctgttgactgttgtggaaatggcccagcagcccttcctcagggagatcatcgaggccatgctgaaagcttatcagcagacgctgtttgtcactcacactgtacatgaactgctctggggctacaaagatgaggtcttgtcgctcgtccatattttcagacctgacgtctcccctaactttggcctgttctatgagagaaatggaactaatgatggggagtatgtttttctgactggagaggacaattacctgaactttacaaaaattgtggagtggaatggaaaaacgtcgctggactggtggacgacggacacgtgcaatatgatcaacgggacagacggagattcttttcacccattaataagcaaggatgagaccctgtacatcttcccatctgacttctgcaggtccgtctatataactttcagtagctttgagaacgtagaaggactgcctgcttttcggtataaggtgcctgcagaaatactagccaattcctccgaaaacgctggcttctgtatacccgagggaaactgcatggacgcgggagtgctgaacgtcagcatttgcaagaatggtgcgcccattatcatgtctttcccacacttttaccaagccgacgagaagttcgtttcggccataaaaggcatgcgtccaaacaaggaagaacatgagtcatttgtggacattaatcctttgacaggaattattttaagaggggccaagagattccaaatcaacacgtacgttaagaagctggatgactttgtggaaacgggaaacattaggactatggttttcccagtgatgtatctcaatgagagtgttctcattgacaaagagactgcaagtcaactgaagtctgtgattaacacaactttgattgtcaccaacataccctacatcatcatggcactgggcgtgttctttggcttgattttcacgtggctggcgtgtcgaggacaggggtctacggatgagggaactgcagatgaaagggcacccctcatacggacctaatgggacttacctgttgcctgagcttggtgagagaatgtgagaactgacctgacctggaccaggacagggaaaagcctgcatctcacgggctcctggcctgtcaagaagggagatgaagccgcagcactggcacgcgagaagaccctcctggacagaggggaccgagcaggtgacatggctggcaattacgctttataaaatcatgtctctgaaactgtgtcaatgtgtcttagggagtatttaataaattatatagaaacctttaaaaacc

SEQ ID NO: 2061 - DNA, 889 bp, Rattus norvegicus
  Genbank Accession No. NM_054008
tgaacacccgagcggaccgcagtgcaggcggcagccaccagggccaacacctctcagcatctctactacacgtgtcactgagcaacctctccatgaagccgccctccacgcagagcagccccgcggccgtggcggccgcagccccggccatggactccgcggccgctgcagacctgacggacgtgctgtgcgagttcgacgcggtgctggccgacttcgcgtcgcccttccacgagcgccacttccactatgaggagcacctggagcgcatgaagcggcgcagcagcgccagcgtcagtgacagcagcggcttcagcgactccgagagtgcagactcgttgtacagggacagcttcaccttcagtgatgagaagctgaattctccgacggactccactccagccctcttgtcctccgctgtcactcctcggaaagccaaattaggtgacactaaagagctcgaagacttcatcgctgatctggacagaaccttagcaagtatgtgaagcaaggagtttgagattcttatgccacaagagtgaaactccagaaggctacgccaggccctggcaaaatcggctactaagtctgctgtgggagcgggcagagctcgcggcatccggccgttcttggttcgccataactttagccattgggtccatctctgggcagttcagataatgaggctgactttgtttacctgcctgcaccatattcaacagatgatctatctaatgtgtttttactccttaaacatagctcttctataaattaaagtgcttttatggaaatatttgtaattacttatatatagttggaggtcataataagctttcccatcataatatatttttgtatacaaataaaatttaaactgggatctgtacct

SEQ ID NO: 2062 - DNA, 760 bp, Rattus norvegicus
  Genbank Accession No. NM_057099
gcggccgccttagctgttcgtggagccgtctctgcaccggcctttgggccggaggcgctcactccagactgggaaaaccgagaagtctccacagggaccacgatcatggctgtgcaatttgacgggggcgtggttctaggagcagactccagaacaaccactgggtcgtacatcgccaatcgagtgactgacaagctgacccctatccacgatcacatcttctgctgccgctcaggctcggcagctgatacccaagcagtagctgatgctgtcacgtaccagcttggtttccacagtattgagctgaacgagcctccactagtgcacacagccgccagtctctttaaggagatgtgttaccgctacagagaagatctgatggcaggaatcatcatcgcaggctgggaccctcaagaaggagggcaggtgtactctgttcccatgggaggtatgatggtaagacagtcctttgccatcggaggctccgggagctcatatatctatggctatgttgatgctacctatcgggaaggcatgaccaaggatgaatgtctgcaattcactgccaatgctcttgctttggctatggaacgggatggctccagtggaggagtgatccgcttggcagccattcaacagtcgggggtagagcggcaggtgcttttgggagaccagatccccaaggtcaccatctccactttgccacctccctgaagcctaggattcccatcccgacgcacaagctaataaacagattgtc

SEQ ID NO: 2063 - DNA, 5236 bp, Rattus norvegicus
  Genbank Accession No. NM_057103
cgggccggcgggagtagaagagccactgagccatgggcgcaggcagttccaccgagcagcggagccccgagcagccggcggggagcgacacgccgagcgagctggtgctcagtggccatgggcccgcagctgaagcctcgggagcagctggagaccccgccgacgcggaccccgccaccaagctcccacagaagaatggccagctgtcttctgtcaacggcgtagctgaacaaggagatgtccatgtccaagaggaaaaccaggaggggcaggaggaagaagtcgttgatgaggatgttggacagcgagagtcagaagatgtgagagaaaaagaccgagttgaagaaatggcggccaactccacagctgttgaagatatcacaaaggatgggcaggaggagacatcagaaataattgaacagatccctgcttcagaaaacaatgtggaagaaatggtacagcctgctgagtcccaggctaatgatgttggcttcaagaaagtatttaaatttgttggttttaaattcacggtgaagaaggataaaaatgaaaagtcagatactgtccaactactcactgtcaagaaggatgaaggcgaaggggcagaagcctctgtcggagctggagaccaccaggagcccagtgtggagactgccgtcggagagtcagcatccaaagaaagtgagctgaagcaatccacagagaagcaagaaggcaccctgaagcaagaacagagcagcacagaaatcccccttcaagccgaatctgatcaagcggctgaggaagaagccaaagatgaaggagaagaaaaacaagagaaagagcccaccaagtccccagaatccccgagcagcccagtcaacagtgagacaacatcttccttcaagaagttcttcactcacggttgggccggctggcgcaagaagaccagcttcaagaaatcaaaagaggatgatctggaaactgccgagaagagaaaggagcaagaggcagaaaaagtagacgaggaagaaaaggaaaagacagagccagcctcggaggagcaggagccggcagaagacacagaccaggccaggttgtcagcagactacgagaaggtggagctgcctttggaagaccaggttggtgacctggaggcatcgtcagaggagaagtgtgctcctttggcaacggaagtgtttgatgagaagatggaagcccaccaagaagttgttgcagaggtccacgtgagcaccgtggagaagacagaggaggagcagggaggaggaggagaggctgaagggggcgtggtggtagaaggaacaggagaatccttgccccctgagaaactggctgagccccaggaggtcccccaggaagctgagcctgctgaggagctgatgaagagcagagagatgtgtgtctctggaggagaccacactcaactgacagacctaagtcctgaagagaagacgctgcccaaacacccagaaggcattgtcagtgaggtggagatgctgtcctctcaggaaagaatcaaggtacagggaagtcccttgaagaaactcttcagtagctcaggcttaaagaagctgtctgggaagaagcagaaggggaaacgaggaggtgggggagacgaagagcctggagaataccaacacattcacaccgaatccccagagagtgctgatgagcagaagggagagagctctgcgtcgtcccccgaggagcctgaggagaccacgtgtctggagaaagggccgctggaagcaccccaggatggggaagctgaggaaggaactacttccgatggagagaagaagagagaagggatcactccctgggcatccttcaaaaagatggtgacacccaagaaacgggtccgaagaccttctgagagtgacaaggaggaagagctggagaaggtcaagagcgccaccttgtcctccactgatagcacagtgtcagaaatgcaagatgaagtcaaaactgttggtgaggaacaaaagccagaggaaccaaagcgtagggtggatacttcagtgtcttgggaagcactgatttgtgtcggatcatccaagaagagagcaaggaaggcatcctcttcagatgatgaaggagggccaaggacactgggaggggacagtcacagagcagaggaggccagcaaagacaaagaagccggaacagacgctgttcctgccagcacccaggagcaggaccaagcgcaaggaagttcctcacccgagccagcgggaagcccttccgaaggggaaggtgtctccacttgggagtcatttaaaagattagtcactccaagaaaaaaatccaagtcaaaactggaagagaaagccgaagactctagtgtagagcagttgtccactgagatcgaaccgagtagagaagaatcttgggtttccattaagaaattcatccccggacggcggaagaaaagggcagatgggaagcaagaacaagccactgtggaagactcagggccagtggagataaatgaggacgaccctgatgtcccagccgtcgtgcctctgtctgagtatgatgcagtggagagggagaagatggaagcccaggggaatgcggagctgccccagctgctgggggctgtgtacgtgtccgaggagctcagtaagactctggtccacactgtgagtgtcgcagtcattgatgggaccagggcagtcaccagtgtcgaagagcggtctccttcgtggatatccgcttccgtaacagaacctcttgaacacacagcgggagaagccatgccacctgttgaagaggtcactgaaaaagacatcattgcagaagaaactcctgtgctcacccagacgttaccagagggtaaagatgcccatgacgacatggtcaccagtgaagtggatttcacctcagaagctgtgacagccacagagacctcagaggctctccgtactgaagaagttaccgaagcatcgggggccgaagagaccacagacatggtgtccgcagtttcccagctgactgactccccagacaccacagaggaagccaccccagttcaggaggtagagagtggtgtgctagatacagaagaagaggagcgccagacgcaggccatcctccaagccgttgcagacaaggtgaaagaggagtcccaggtgcctgcaacccagactgtgcagagaacggggtcaaaagcactggagaaggttgaggaggtagaggaggactccgaagtgctggcttcggagaaagagaaggacgttatgccgaaaggacccgtgcaggaagctggagctgagcatcttgcacagggctctgagactggacaggctactccagagagccttgaagttcctgaagtcacggcagatgtagaccatgtcgccacgtgccaggttatcaagctccagcagctgatggaacaggccgtggcccctgagtcatccgaaaccttgacagacagtgagacaaatggaagcactcccttagcagattcagacactgcagatgggacacagcaagatgaaaccattgacagccaggacagtaaagccactgcagctgtcaggcagtcacaggtcacagaagaagaggcggctactgctcagaaagaggagccttcgacactacctaataatgttccagcccaggaagaacatggggaagaaccaggaagagatgttcttgaacctacacagcaagagcttactgctgcagccgtgcccgttctggcaaagactgaggtgggtcaagagggtgaggttgactggttggatggagaaaaagtcaaagaagaacaggaggtgtttgtacactctggacccaacagtcaaaaggctgctgatgtgacatatgacagtgaagtgatgggagtggccgggtgtcaggaaaaggagagtactgaagtgcagagtcttagcctggaggagggagagatggaaactgacgttgaaaaggagaaaagggagacaaagccagagcaagtgagtgaagaaggtgagcaggaaacagccgctcctgagcatgaaggaacctacgggaagccagtcctgacacttgacatgcccagctcagagagggggaaggcactgggaagccttggaggaagcccttctctcccagaccaagacaaagcaggttgcatagaggttcaagttcaaagcctggacacaacagtcactcaaacagcagaagctgtggaaaaggtcatagaaacggttgtgatttcagagacaggtgaaagtccagagtgtgtaggtgcacacttattaccagctgagaagtcctctgcaacgggtggccactggactcttcagcatgcagaggacacggtacccctggggcctgagtctcaggcagaatccatcccaatcatagtaactcctgctcctgaaagcaccctacatcctgacctacaaggagaaataagcgcatcccagagagagcgatcagaggaagaggacaagccagatgctggtcctgatgctgacggcaaggagagtacagcaatcgaaaaagtcctcaaggctgaacctgagatcctggaacttgagagtaagagcaacaagattgtgctgaacgtcattcagacagccgttgaccagttcgcacgtacagaaacagcccccgaaactcatgcttatgattcacagacccaggttcctgcaatgcaggctgacagcagggagcccaacagatgctggacaaaaatgaaagttgccaagatgaaacacccagtgccgcagcccagagaggacttgcaagtcctgaccgttctggaggcatgggctcagcctcggaaatgcttgccgcgcttgcagttgaaagcgccggtgtcaaagtaagcattgagaagctgcctcctcaacccaaagatcaaaaggagcatgctgctgatggccctcagctccaaagcttagcccaggcagaggccagtgcctctggaaacctaaccaaagaatccccagacaccaacggaccaaagctaaccgaggagggcgatcgcccaaaagttgaggtccaggaagaagaaatgtctaccaagtcagtcaaagagaacaaggcccaggcagaagaggacctgcaggagccaaagggagacctggcagaatcctaagatgttagttgctcattgtacatctgtaagaccagaatgtgaaaacaagtcacagaacaagatgctgctgttgggaccttgagaccaagatttcagagcccatgagatccagagagcagggccgtccaatgatttccaccc

SEQ ID NO: 2064 - DNA, 1593 bp, Rattus norvegicus
  Genbank Accession No. NM_057105
atggcttgccttcttcctgctgctcgacttcctgcaggctttctcttcttagtgctctggggctcagttctaggtgacaagctgctggtggtcccccaggatggcagccactggcttagcatgaaggagatagtggagcacctcagtgaacgcggacacgacattgtggtgctagtgccagaagtcaatttgcttttgggagaatccaaatactacaggaggaaaagcttcccggtcccctacaacctagaagagttgcggacccgctatcgctcctttgggaacaaccactttgctgccagttcccccctgatggctcctctaagagagtacaggaacaacatgattgtcattgacatgtgctttttcagctgccagagcctcctgaaggactcggccaccctcagcttcctcagggagaaccagtttgatgctctgttcacagacccggccatgccctgtggtgtgatcctggctgagtatctcaagctgccttccatctacctcttcagaggtttcccatgctctctggagcacatgcttggtcaaagcccaagccccgtatcctatgttcccagattctacaccaaattctcagaccacatgacatttccccaacggctggccaacttcattgctaacatcttggagaactacctttatcattgtctgtactcaaagtatgagatccttgcctcagacctcctcaagagagatgtgtccctacctgccttacaccagaactctctgtggctgttacggtatgattttgtgttcgaatacccccggccagtcatgcccaacatgatcttcattggagggaccaactgcaagaagaaggggaacctgtctcaggaatttgaagcctatgtcaacgcctccggagaacatggcatcgtggttttctctttgggatccatggtctcagagattccagagaagaaagcgatggaaatcgctgaggctttgggcagaattcctcagacggtcctgtggcgctacaccggaactagaccatcgaaccttgcaaagaacactattcttgtcaaatggctaccccaaaacgatctgcttggtcatccaaaggctcgggcgttcatcacacactccggttcccatggtatttatgaaggaatatgcaatggggttccaatggtgatgatgcccttgtttggtgatcagatggacaacgccaagcgcatggaaactcggggagctggggtgaccctgaatgtcctggaaatgactgccgatgatttggaaaacgcccttaaaactgtcatcaataacaagagttacaaggagaacatcatgcgcctctccagccttcacaaggaccgtcctatcgagcctctggacctggctgtgttctgggtggagtacgtgatgaggcacaagggggcgccacacctgcgccccgccgcccacgacctcacctggtaccagtaccactccttggacgtgattggctttctcctggccatcgtgttgacggtggtcttcattgtctataaaagttgtgcctatggctgccggaaatgctttgggggaaagggtcgagtgaagaaatcacacaaatccaagacccactga

SEQ ID NO: 2065 - DNA, 2779 bp, Rattus norvegicus
  Genbank Accession No. NM_057107
tgtaaaacttgattcccgttgagatctgttgattgtatttttgagcacatgaataaccacgtatcttcaacaccgtctaccatgaagctaaaacaaaccatccaccccatacttttatatttcatacattttataatatcactctatactattttaacatacatcccattttattttttgtgtgagtcaaaacaagagaaaccaaaccacattaaagcaaagcctgtcagttcaaaaccggactctgcatacaggtctgtcaacagtatggatggcttagcttcagtattgtatcctggctgcgacacacttgataaagtttttatgtatgcaaaaaacaaatttaaggacaaaagactattgggaacacgtgagattttgaatgaggaagatgaaatacaaccaaatggaaaggtttttaaaaaggttattctggggcactataattggctttcctatgaagatgtcttcattcgagccctcgattttggaaatgggttacaaatgttgggccagaagccgaaggccaacatcgccatcttttgtgagaccagggctgagtggatgattgctgcgcaggcgtgtttcatgtacaacttccagcttgttacactgtatgcgactctgggaggtccagccattgtccatggactgaatgagacagaggtgaccaacatcattactagtaaagaactcctgcaaacaaagctgaaggatatcgtctctttggtcccacgtctgcggcatatcattactgttgatgggaagcctccaacctggtctgagttccccaagggcgtcattgtacacaccatggctgcagtgcaggctctaggagtaaaggctgacgtggacaagaaagctcacagcaaaccactgccctcagatattgcagtaatcatgtacacaagtggatccacaggaattccaaagggagtcatgatctcacacagcaacatcattgcctctataacggggatggcgagaaggattccaagactgggagaggaagatgtatacattggatatttgcccctggcacatgttctagaattaagcgctgagcttgtgtgtctttctcatggatgccggattggctactcttcaccacagacattagcagatcagtcttcaaaaataaagaaaggaagcaaaggagacacatccgttctgaagcccacgctgatggcagctgtgccggaaatcatggatcggatctacaaaaatgtcatgaataaagtgaatgaaatgagtgcttttcaacgaaacttgtttattttggcatataattataagatggagcagatttcaaaagggtgtagtaccccgctgtgtgaccgctttgttttccggaatgtccgaaggctgctgggtggaaatattcgcgttttattgtgcggtggtgctccactttctgcaacgacacagcgattcatgaatatctgcttctgttgtcccgttggccaggggtatggactcacagaatctactggggctggaacaattacagaagtgtgggactacaataccggcagagtgggagcaccattagtttgctgtgaaatcaaattaaagaactgggaggaaggtggctattttaatactgacaaaccacatcccagaggtgaaattctgattggtggccaaaatgtgacaatggggtactacaaaaatgaagcaaaaacaaaggccgatttctttgaagatgaaaacggacagaggtggctgtgcactggcgatattggagagtttgaccctgatggctgcctcaagatcattgatcgtaaaaaggaccttgtgaaactacaggcaggagagtatgtttctctaggcaaagttgaggcagctttgaagaacctcccactgatagataacatttgtgcatatgcaaacagttaccattcttacgtaattggatttgttgtgccaaatcaaaaggaacttacggagctagctagaacgaaaggatttaacggaacttgggaagagctgtgtaacagcagtgaaatggaaaacgaggtccttaaagtgctttctgaggctgctatttcagcaagtctggaaaagtttgaaatcccactgaaaattcgtttgagccctgacccatggactcccgaaactggtctggtgactgatgccttcaagttgaaacgtaaagaacttaaaacacactaccaggcagacattgagcggatgtacggaagaaaataattagtttgggcattggtttgctacagtgagctcagatcaaatagggaaatacttgaaatgtatgtctcaggccaaggcaaactccattcctcatattaaaccctggctgttacttctcactacgtcaccatttttaactgacaggattagtaaactattaagacagcaaacatgtgtctgtctctgttttttcccctcctccagtttgctttggcatctatgactgtgtttgtcaataggagactttttcaaaatcatactggggaagcagtgattttaaaacctcaagtttttaaacatgatttatatgttctgtacaattgttcagtttgtaactttttaaagtttggatgtatagaaggataaataggaaatataaaaattggttatttgggggcttttttacttattgtatttaaaaataaaagggtatcaatgtgaaattatgtaaattttaaatgcttatgaatcaaatcattgttgaacaaaagatttgttgctgtgtaattattgtcttgtacgcatttaagagaaataaatatactcagacttatgttttaagaaatgg

SEQ ID NO: 2066 - DNA, 882 bp, Rattus norvegicus
  Genbank Accession No. NM_057114
ggctcacggttggttctgtttgtgagacctgtagctcgactctgctgatagcaagatgtcttcaggaaatgcaaaaattgggcatcctgctcccagcttcaaagccacggctgttatgccggatggacaattcaaagatatcagcctaagtgattacaaaggaaaatatgttgtattctttttttaccctcttgactttacttttgtgtgtcccacggagatcattgctttcagtgatagagcagaagaatttaagaaactcaactgccaagtgattggagcttctgtggattctcacttctgtcatctggcatggattaacacacccaagaaacaaggaggattgggacccatgaacattcccttggtatcagatcccaagcgcaccattgctcaggattatggagtcttaaaagctgatgaaggtatctctttcaggggcctctttattattgatgataaaggtatccttcgccagataacaataaatgatcttcctgttggccgctctgtggatgagattctgagactagtccaggccttccagttcactgacaaacatggtgaagtgtgcccagctggctggaaacctggcagtgataccatcaagcctgatgtcaataagagtaaagagtatttctctaagcagaagtgagcactggaccagttttctggcagacagctttgagcagccagaagaaatttgtactctacacatgacgtggtgtgattccagataagcctttcctacaagggctaggggtggttagcctttcttccactattggtaaggggcagaccatcttatatcagtcacagaaaccaacctgttaattctctctctctcttttttttttttaagtatctattaaacgtgaattc

SEQ ID NO: 2067 - DNA, 1556 bp, Rattus norvegicus
  Genbank Accession No. NM_057123
acgactgaaggagagatgggtcaaagtcagagtggtggccatggtcctgggggtggcaagaaggatgacaaggacaagaaaaagaaatatgaacctcctgtcccaactagagtggggaaaaagaagaagaaaaccaagggaccagatgctgccagcaaactgccactggtaacacctcacacccagtgccgcctgaaattactaaagctggagagaataaaagactatcttctcatggaggaagaattcattagaaatcaggaacagatgaaaccactagaagaaaagcaagaggaggaaagatcaaaggtggatgatcttaggggaaccccgatgtctgtaggaaccttggaagagatcatcgatgataatcacgccattgtgtccacatcggtgggctcagaacactacgtcagcatcctgtcatttgtagacaaggatctgctggaaccgggctgttcagtcctgctcaaccacaaggtgcatgctgtgataggggtgctcatggatgacacggatcccctggtcacagtgatgaaggtggaaaaggccccccaggaaacctatgcagatattgggggactggacaaccagatccaggaaattaaggaatctgtggagctccctcttacccaccctgagtattatgaggagatggggataaaaccacctaagggggtcattctctacggcccgccaggaacaggtaaaactctattggccaaagcagtagcgaaccagacttcagcgactttcttgcgagtggttggctcagagcttattcagaagtacctaggtgacgggcccaagctggtccgggagctcttccgggtcgctgaggaacacgcaccgtccattgtgttcattgatgaaatcgacgccattgggaccaaaagatatgattcaaactctggaggtgagcgggaaatccagcggacaatgttggaactgttgaaccagttggatggatttgattcgaggggagatgtaaaagttatcatggccacaaaccgaatagaaactttggatccagcacttatcagaccaggccgcattgacagaaagatcgagttccccctgcctgatgaaaagaccaagaagcgcatcttccagatccacacaagcaggatgacgctggctgatgatgtaaccttggatgacttgatcatggcaaaggatgacctctctggggctgacatcaaggcaatctgcacagaggctggcttgatggctctgcgggaacgcaggatgaaagtgacaaacgaagacttcaagaaatctaaggagaacgttctgtataaaaaacaagaaggcacccctgaggggctgtatctctagtgacacagttgtcttcagggaacttaatgagtttcccccacctgggaagatgggaagctgccccaaggaatccatcttccagttaagttttgctagtagaaagcccgtgtcgtggaggacgctgtgtggtctgtctccaatctgttgttggtcattgtgccctgcagctctccgctcccaataaaggattgtcctggtttgctttctaaaaaaacaag

SEQ ID NO: 2068 - DNA, 1922 bp, Rattus norvegicus
  Genbank Accession No. NM_057124
tggaactcttggaaccagagctgaacagcttgaccgcagggaccgcaaggctggtgctgcgcagggcagaacgccatcaaccaagcccaagaccagccccagccacacggcgagaccttgtctccagcacgagagactctgtactcaggaagccatggttgctcactcccctcccagcccctgcttgtctattctgtctctggataagttcttcctataaactctgactgaaagaacatggctctcgaaggtggaattcaggctgaggacggtggtgcttctctcagagaactctgtgtgtgtgcactgtccacaggggtaaactaagacccaacctgccttgacaacgaggaacaccagagctggtacatcctcctaagacatcgtccatcttgcatgagacagattctccaagcataggaaaagcaggccgccagttatggagcgggacaatggcaccatccaggctccaggcttgccgcccaccacctgcgtctaccgtgaggatttcaagcgactgctgctacccccagtttactcagtggtgctggtggtcggcctgccactgaacgtctgtgtcatcgcccagatatgcgcatcccgccggaccctgacccgttccgctgtgtacaccctgaacttggcactggcggacctgctgtatgcctgttcactgcccctacttatctataactacgccagaggggaccactggcccttcggagaccttgcctgccgcctggtacgcttcctcttctatgccaacctacacggcagcatcctgttcctcacctgcattagcttccagcgatacctaggcatctgccatcccctggccccctggcacaagcgtggaggtcgccgtgctgcttgggtggtatgtggagtcgtttggctggttgtgacagcccagtgcctgcccacagcagtctttgccgccacgggcatccagcgcaaccgcactgtctgctacgacctgagcccacccatcctgtccacccgctacctgccgtatggcatggccctcacggtcatcggcttcttgcttcccttcacagccttactggcctgctactgtcgcatggcccgccgcctgtgtcgccaggatggcccagcaggtcctgtggcccaagagcgtcgcagcaaggcggcccgtatggctgtcgtggtagcagctgtctttgttatcagcttcctgcctttccacatcaccaagacagcctacttggctgtgcgctccacgcccggcgtctcttgcccggtactggagaccttcgctgcagcctacaaaggcacccggcccttcgccagtgctaacagcgttctggaccctatcctcttctacttcacacaacagaagttccggcggcaaccacacgatctcctacagaagctcacagccaagtggcagaggcagagagtctgagaccccaggggaggccctgaagcactggctgcaatgtgtttgcccactggggtcatggtgcctgaagctttctcccaatcggaaaccataccgagaagaagcaaaacttggcccaacatgcctggccctccaaaatttctatgtcaaccacaaaactaagacacctgtgtttcggggactggtcagttcatgcttgttataccagaattcaggatgtcatgacaggataacaagctctaagccagcctggtctacatggtgaaaccccatctcagacaatcaagggttgagctaggtcctggaatagcactgcaaattctaacaaaggtcttcccgcctgaccgttcttgtgtttacaaggtagaggggaccactggtacaccatcacgaacgtgaggcaaggcccctcctgtagaggaagaagctgggaaagctcacattcccatccatttgccaagacttttgcacaggagagagaaataaatgtgttcttgtg

SEQ ID NO: 2069 - DNA, 1612 bp, Rattus norvegicus
  Genbank Accession No. NM_057131
gccattttgctgtaagacgctgtgcggagctctgagctctttttccttcggacagccgaggcctggcgggccgggctggggtcgggaccaggaagaataacagagaggttaacagaatacaggataacaggagaataacaggaggttgtccataattgactttaagcagcaaacagtaaaacactgagctcttcagctccgcctttcttgctcttagaattggaacgccaagaaggttttgatgttttgtgtggcgcctcctgaattagaaaccaagatgaacataaccaaaggaggcctcgtgttgttttcagcaaattccaattcatcatgtatggagctttcaaagaaaattgcagagcggctgggggtggagatgggcaaagtgcaggtttaccaggaacctaacagagaaacacgagttcaaatccaggagtctgtgagagggaaagatgtatttatcattcagaccgtctcgaaggacgtgaacaccaccatcatggagctcctgattatggtatatgcatgtaagacctcttgtgccaagagcatcattggagtgatcccctactttccttatagcaagcagtgcaagatgagaaaaaggggctctattgtctcaaaattgctggcttctatgatgtgcaaagctggtctgactcatcttatcactatggatttacaccagaaggaaatccagggcttcttcaatattccagtggataatttaagagcctcccctttcctgttacagtatattcaagaagagatcccagattataggaatgcagtcatcgtggccaagtctccagcctcagccaagagggcacaatcttttgcagagcgtctacgcctggggatcgcagtgatccatggagaagcacaggatgctgagtctgacttggtggatggccggcactccccaccaatggtcaggagtgtagctgccatccaccccagcctggagatcccaatgctgattcctaaagaaaagcccccaatcacagttgttggtgatgttggaggaagaattgccatcatcgtggatgacattattgatgatgtggacagctttcttgctgcagcagagaccctaaaggaaagaggtgcatataagatctttgtgatggcaactcacggcttgttatcctctgatgctccccggctgattgaagagtctgccattgatgaggtggtggtcactaacacgatcccacatgaaatccagaagttgcagtgccccaagatcaagactgtggacatcagcatgatcctctcagaagccatccgccgaattcacaacggggagtccatgtcctaccttttcagaaacataggcttagatgactgaacagttctcctatggcagaactcccacaggtcaagtgggaggcccagcatatatgctggaaggcccatgcccagctagatacttgaccctcccttcctgacatcttcctgattgattcctgtgaaggtacaaggaccagctttcttaatgttggtttaggtttttgtgagtttgggggataatttttataacagaaagacctctttttaaataaaagaagttaaaacctaaaaaaaaaaaaaaaaaaaaaaaaataaaaaa

SEQ ID NO: 2070 - DNA, 853 bp, Rattus norvegicus
  Genbank Accession No. NM_057144
tcatctcggcagattgactttggcccctgagtcttcaccatgccgaactggggtggaggtgcaaaatgtggagcctgcgacaagacggtttaccatgcagaagaaatccagtgcaatgggaggagcttccataagacctgtttccactgcatggcctgcaggaaggctctggacagcaccacagtggcagctcatgagtcagagatctactgtaaggtctgctatgggcgcaagtatggccccaaggggatcgggtttggacaaggcgctggctgcctcagcacagacaccggcgagcaccttggcctgcagttccaacaatccccaaagccagcacgtgcagccaccacgagcaacccttccaagttctctgcgaagtttggagaatcagagaagtgcccacgatgcggaaagtcggtatatgctgctgagaaggtcatgggaggtggcaagccctggcataagacctgctttccgtgcgccatctgtgggaagagcctggagtccacaaatgtcactgacaaggatggggagctttattgcaaagtttgctatgccaaaaattttggccccacaggcattgggtttggagggcttacacaccaagtggaaaagaaggagtgaaacggcgtgctttctcacagccctgctagtcaacagcagggcttagtgaccccatagatgtaactttggccccgcagcctcctttgtagctggactgcatttctcttcagaagcagtcataggctgcactgaccgtaaaaagagaccaccggaaatgaatctgcaaaagatgcttcattatttactatttttggggtgggagagacaataaacgttttaatggtaaaaa

SEQ ID NO: 2071 - DNA, 2828 bp, Rattus norvegicus
  Genbank Accession No. NM_057155
ttcccttgatctactcatcgccagcatctggagacccaatggcccaagcctactggcaatgctacccctggcttgttctcctctgtgcatgtgcatggagttacccagggcctgagtcccttggaagagaagatgtgagagactgttcaaccaatcctccgcgcctgccagttactgctgtcaatacaacaatgcggcttgcagccctccgccagcagatggagaagtcgaatctctctgcctacatcatcccagacacggatgcacacatgagtgagtatattggcaaacatgatgagaggcgagcatggatttctggcttcacagggtctgcaggtactgctgtggtgaccaagaaaaaagcagctgtctggaccgatagtcgttactggactcaggccgagaggcagatggactgcaattgggaactccataaggaagttagcatttcgtcaattgtcgcctggatcttagctgaagtccctgatggagagaatgtgggctttgaccccttcctcttttctgttggttcctgggaaaattatgatcaagaactccaagactccaacagacaccttttatccattacaaccaaccttgtcgacgtggcatgggggtcagagaggcccccagtgccaagccaacccatttatgccctgccaaaagaatttacaggaagcacttggcaggaaaaagtatccgccatccgaagctatatgcagaaccacaccatggctccaactggggttcttctatccgcactcgatgagacagcctggctcttcaacctccgtagcagtgacatcccctataaccccttcttctactcctatacgctgctcacggactcttccatcaggttgtttgtcaacaagagtcgctttagcctggagaccctgcagtacctgaatacaaactgcacactacccatgtgtgtacaacttgaagactacagtcaaattcgtgatggtgtgaaagcctatgcttcaggcaatgtgaaaatcttgattgggatcagctataccacctatggggtctatgatgtgataccaaaggaaaaactcgtgacagagacctactccccagtgatgttaatcaaggctgtgaagaacagcaaggagcaggccctcttgaaagccagccatgtgcgggacgctgtggctgtgatccagtacttggtctggttggagaagaacgtgcccaaaggcacggtggatgagttttctggagcggaacacattgatcagttacgacggaatgaaaacttctcctctggacccagttttgaaaccatttctgctagtggcctgaacgccgccctggcccattacagcccaacaaaagagctgcaccgtaagctgtccttagatgagatgtacctggtggattctggaggccaatactgggatgggaccacagatatcaccagaacagtacactggggtactcctactgcctttcaaaaggaggcttacacgcgtgtgctgatgggaaacatcgatctgtccagacttgtctttcctgctgctacatcagggagagtggtggaagcctttgctcgaagagccttatgggaagttgggctcaattatggtcatgggacaggccatggcattggtaatttcctctgcgtgcatgagtggccagtggggttccagtataacaacatggccatggccaaaggcatgttcacttccatcgaacctggatactaccaggatggggaatttggaatccgtcttgaagacgtcgccctcgtggtagaagcaaagaccaagtacccagggacctacctgacttttgaattggtatcctttgtaccctatgaccgaaacctcattgatgtcagcctgctgtccccagagcagctccagtacctgaaccgctactaccagaccatccgtgagaacataggcccagaactgcagcgtcgccagctgctggaggaattcgcatggctggagcggcacacagagcccctgtcagccagtgcccctcataccacgtccttggcctctatgtgggtagcctctgcccttgccatcctcagctggagttgctagaggcccccaattctcctgttgactgttgggtttggggattcatttgcttctgctcagctgtcctctctcctgtgtcatacatgtcccacggggccctgatggctcagccactgtcctaaatgtcctccagagccagatcctaggtagcatattctaccttctcccagatgtgcatacctcatcatggacttccacccctgggccctggactagcagagccatatagcctgctacatgggatccctctctcccaaagtaaaggaccctatagggtaatacccctatttatagttcacagggctccatcccatctccactcactggagaaggccagggctattgccacccacactgactccagactttctaaagctgcctctggccacccttacctgcaggcctaccgtagcctgtttgctatctttggagaaggaggtgactgtgtattctggtctcaaactaccactctagtattagggagaacagaaaagctgaaagtcaactgtggcctgcaattgaacacctcagttgatgatgggtatcagtcctctccccaactgtgaacccacaactccttaactaccaatgcaccccttaacaagccaccacgcagggagttaaggcacaggacttagactgtgaagtagaagagagaatggaaaggtgttctgggctatcccagactcccctgacacttaatcttctaaggtgaagtcaccatgacagtgctattaaaccctctcatatctttaaaaaaagacgctt

SEQ ID NO: 2072 - DNA, 1569 bp, Rattus norvegicus
  Genbank Accession No. NM_057194
agtgctggctcgcgtcatccagagtgagtccctctgcgaggctttagggagagctgtgcgacagctgcaccactagcaaggggttgggactcacgactgccaggagccagctgtccaccttgcagacctcagagcagaaggagcctcagtttaaatcatggagaagcacggaccaccagaacatgctgcttaccccattcctcaggctgactaccaagggtcccagggtccctatccaggaccgcagggtccatatccagggccccagggtccctatgcagggcctcaaggtccctatccagggccccagggtccctatgcagggccccaaggtccctatccagggccccaacctggctacccagttccaccaggcagttatgcaggtggtgacccaagtggctttcctgtccaacatcagccggcgtataatcacccaggtggacctgggggcaccccatggatgcaagcaccacctccacccctggactgtccgcctgggctggaatacttaacgcagatagatcagattctggttcatcagcagattgaacttctggaagtcttaacaggctttgaaacaaataacaaatatgaaatcaagaacagccttgggcagagggtttactttgcggtggaagatacggactgctgcactcgaaactgctgtggggcgtctagaccgttcaccttgaggatcctggataacatgggccgagaagtcatgactctggagagacccctgagatgcagtagctgctgcttcccctgctgcctccaggagatagaaatccaggctcctcctggggtgccagtaggttatgtgattcagacctggcacccatgtctgccaaagttcactctccaaaatgagaagaggcaggacgttctaaaggtcgttggtccgtgtgttgtgtgtagctgctgttcagacattgactttgagctcaaatctctagatgaggaatccgttgttggcaaaatttccaagcagtggtctggttttgtgagagaggccttcacggatgcagataacttcgggatccagttcccgctggacctggatgtgaagatgaaagctgtgatgcttggcgcttgtttcctcatagatttcatgttttttgaaagaactggaaatgaggaacaaaggtcaggagtatggtagtagtttcccaagattcctcggctgtaaggactgcatgccgatagacgctgagaggagatcaaggaatcaaaggaacgcaccatggcttcttttcctttactgaaataactttatatcaattaacctgtgatggctgtaggcccttttgtacaattgtgctctcaaattagagtttattttctgtaactctgtcatgtatttgtttttatacattcttaaggttgtcactgtgaatttgtgaaaaaaatatatgaatttatcaacatagaaatgatcttgtctatgaaaagaggctttgacttagtctttcattcattttcatttttatgaaaacttaaatatattgttatttaatataaagctacatattaaatgtaatttaatttaaaaaaaaaaaaaaaaaa

SEQ ID NO: 2073 - DNA, 1109 bp, Rattus norvegicus
  Genbank Accession No. NM_057197
gaattccctgctgcaaacatggcgctgctggcccgtgcgttctttgctggggtgtcccgcctcccctgcgatcccggtcctcagaagtttttcagctttggaacgaaaaccctgtatcaaagcatcgatgctccacagtctaaattcttcccacccattttaaagcctatgctaccacctaatgcctttcaaggaaaagtggctttcatcacgggaggaggcactggccttggcaaggcaatgacaactttccgctccagcctgggtgcccagtgtgtgatcgcgagcaggaatattgatgttctgaaagctactgcagaagagattacttctaaaactggaaataaggtctatgcgattcggtgtgacgttcgagatcctgatatggtacacaacacagtactggagctgatcaaagttgcagggcatcctgatgtggtgataaacaatgcggcagggaacttcatttctcccagtgagagactgtctcccaatggttggaggaccataactgacatagttctcaatggtacagcctatgtgacgatagaaattggaaagcagctaattaaagcacagaaaggagtcgcctttcttgctatcactacgatctatgctgagagcggatcaggctttgtaatgccaagttcttcagccaaatcaggcgtggaagccatgaataagtctcttgcagctgaatggggtagatacggaatgcgtttcaacataattcagccagggcctatcaaaaccaaaggtgcctttagccgtttggacccgactggaaaatttgagaaagatatgatcgagagaatcccctgtggtcggctgggaactgtggaggaacttgccaatctagcgactttcctttgcagtgattatgcctcttggatcaatggggcagtcattcgatttgacggtggagaggaagtgtttctgtcaggtgaattcaactctctaaagaaggtcaccaaggaggagtgggatgtaatcgaaggcctcatcagaaagacaaaaggctcctaagacgttcatggcttcctctgtgacaaactaaagtttagggactatatagatggacatttgagttaataaattttttgtctgat

SEQ ID NO: 2074 - DNA, 2934 bp, Rattus norvegicus
  Genbank Accession No. NM_057198
gcggacagctggttggcgcttggaccacgccgcagcagcaggtccctccacgtgctttcggcggcgccatggaactggaggagtcggggatccgtgaggaatgtggtgtgttcgggtgcatcgcttctggagactggcccacgcagctagatgtgccacatgtgatcactctgggactcgtggggcttcagcaccgaggtcaggagagcgctggtattgtgaccagtgatgggagttcagtgcctaaattcagggtgcataagggaatgggccttgtaaatcatgtttttaccgaagacaatttgaagaaattgtatgtctcaaatcttggaatcggacatacgcggtacgccaccacagggaagtgtgagctggaaaattgccagccgtttgttgttgagactctgcatgggaaaatagctgtggcccataacggagagctggtgaacgcagctcggctgaggaagaagcttctgcggcatggtattgggctttccacatcctccgatagtgaaatgattacccagttactcgcatatacccctcctcaggaacaagatgatactccagactgggtagcaagaattaagaacttaatgaaggaagcgcccgcagcctactccctggtcataatgcacagggacgtcatttacgcagtgcgagatccatacggaaatcgtcctctatgcatcggccgtcttatgccagtttctgacataaatgacaaagagaaaaagtcttcagagactgaaggatgggtggtgtcctcagagtcttgcagctttttatctattggtgcgagatattgccatgaagtgaagcctggggaaattgtagaaatatccagacatggtgtcagaactcttgatataattccaaggtctaatggagacccagtggctttttgtatcttcgaatatgtttattttgcaagaccagatagtatgtttgaagaccagatggtttatacggtaaggtaccggtgtggccagcagctggcagttgaagcaccggtggaggcggacctggtcagcacagttccagaatctgccacgcctgcggccctggggtatgcgacaaagtgtgggctgccatatgtggaggtgctgtgtaagaaccggtatgtaggaagaaccttcattcagccaaacatgaggctaagacaacttggggttgcaaagaaattcggcgtgttgtctgacaactttaaaggcaaaagaattgttctcatagatgattccattgtgagaggcaatactatctcacccatcataaaactcctcaaagaatccggtgcaaaggaggtacacattcgagtcgcttcgccaccaataaaacatccgtgcttcatgggaataaacattcctacaaaagaagagcttatagccaataagcccgaatttgagtatcttgcagagtaccttggagcaaacagcgttgtgtatctgtcagtggaaggactagtttcgtctgtgcaacaagaaataaagttcaagaagcagaaagttaaaaagcgtgatatcacaattcaagaaaatggaaatggtctggagtattttgagaagacgggacactgtacggcttgcctcactggccagtaccctgtggatctggaatggtagctgcctggaccgatgtgctgcttccagactgaaaggtcatcaagaagtggtttacatgtgttcctcagttggtacaaaatggacaccacttgcttatgtattataccttaagttttgagattttctgaggtcactgaattgctataattgaatcataaagattacatgtaatgcgacatgtggggattctttttgtataaggactgacttttcacccaagagaaggcaggaagtggcatttcccagacccatgcttgaatggttctaaagaggtgagatagggaggttgtgtgcccaggacaggaagctttataaagtttcatgaaaagcttgaattcattgtgccccatatgtatctagtctatgcagtcaagtctgcagttatggccttggtctttgattcttccaccccatacacacatgtatggctctggggaccagtgtacaactcctaaaaaatgaaaacctatgtggaaagctgaggcaggagagtcctgagttcaaggccaacctgggttttcctgtctcaagataaagaacctctttctgtgcctcggactccacatctgtttcctaagtcattcataaacttaatgcttagcgggaacttgtgtgtttgtctgggaggcttagagctgccgttttacccctgcttctttaccatgcatggtcagtagcttcagaagctaatggtaattagctttcactaaattagttttcagtttccttgtgatggaggtttgcagaccttttccatctctttgggatataccagaacgactgagaaatctatctggagccctgtttttctacacttgacagaaaatatttagcctagcaaataacttagtaagtacattggaaagagaaaattttaatttcaagtaagcctttatccttgatttgattaaacttggctgtttgaatgagtgcttgatcatttacagaactgtgtacttgtatacatgtatgcatttggtttaaacagagggaatagagacacagtagggccgattttgtttaaaggctgaggggacagccactgtttggggaattagattgcctgtacccaagcgttagctcatgatcatgttttttctaattttttttgttaggtctagtgacatttttaatttttttatgatgcagatttagtggattgaggtgatttactaactcctgtttgtgtgggatttttcacatggaaaaataattgtctctatattgccaaaatttgctactttccaaacccacttagaaatataatatttattaaaaactgaaatcattagcccacatttggtatatagtg

SEQ ID NO: 2075 - DNA, 1101 bp, Rattus norvegicus
  Genbank Accession No. NM_057208
agcagctgggtaggcaccatggccgggagcaccaccatcgaggcggtaaagcgcaagatccaggttctgcagcagcaggctgatgatgcggaggagagggctgagcgcctccagcgggaagtggagggagaaaggcgggcccgggagcaggctgaagctgaggtggcttccttgaaccgtaggatccagctggttgaagaggagctggaccgcgcccaggagcgccttgccactgctttgcagaagctggaggaagcggagaaggctgctgatgagagtgagagaggtatgaaggtgattgaaaaccgggctctaaaagatgaagaaaagatggagctccaggaaatccagctgaaggaagcaaagcacattgcagaagaggcagacaggaagtatgaagaggtggctcgtaagttggtgatcattgaaggagacttggaacgcacggaggaacgcgccgagctggcagagtctaagtgttctgagctggaggaggagctgaagaatgtcaccaacaacctcaaatctcttgaggctcaggcggagaagtactctcaaaaagaagacaagtatgaagaagaaataaagattcttactgataaactcaaggaggcggagacccgggctgagtttgctgaaagatcggtagccaagctggaaaagaccattgatgacttggaagatgagctctatgcccagaaactgaagtacaaggccattagcgacgagctggaccacgccctcaatgacatgacctctatataaactgacaccgtttctgctctgtcctggatctacccccctttcaggggtaattgatatgatataaggggcctaggaatacaattgatgttagggcgtttattagaataatgttggtgtactcggctatgaagaatagggcgaatggtcctgcggcgtattcgacgttaaagcctgagactaattctgattctccttctgttaagtcgaagggagctcgatttgtttctgctagggttgaaatgtatcatattatggctattggtcaggcggggattaatagtcagatatgttcttgtgcacttataagtatttctagggagaaggagccgcttatta

SEQ ID NO: 2076 - DNA, 3844 bp, Rattus norvegicus
  Genbank Accession No. NM_057210
cctcagccctgtggctggaccccctccctcacccggggactccctgacccggggaaccaagctcaggtctccagagcctcccagaagaaaaataggcagccctccctgaaatatcttggctcctcagtttatcctttccaacctggctcccccttcccagttcccctccctactccctgtctccctccccaactcaccctactgaactgggtgcagagcaaagcccttttcgcccttttccccatctggacttctctggccagttcctcttagtccgatcccaaagacactggaacacatttctaaagggtcttcttgatccctccaattcattgagcaaagggctgaaaaagaagcagagagtaaggtagagccagtgactcgcccccaagccccatcatggaagaaggctttcgagaccgagcagcgttcatccgtggggccaaagacattgccaaggaagttaagaagcacgcggccaagaaggtggtgaagggtctcgacagagtccaggatgaatattcccgaaggtcctactcccgctttgaggaggaggaggatgatgatgacttccctgcccctgctgacggctattaccgcggagaaggggcccaggatgaggaggaaggtggcgcttccagtgatgccactgagggccacgatgaggatgatgagatctacgagggagaatatcagggcatcccccgggcagagtctgggggcaaaggcgaacggatggcagatggggcacccctggctggagtgagagggggcttaagtgatggggagggtccccctgggggtcgcggggaggcgcagcggcgtaaagatcgggaagaattggctcagcagtatgagaccatcctccgggagtgcggccatggtcgcttccagtggacactctacttcgtgctgggtctggcgctgatggccgatggtgtagaggtctttgtggtgggctttgtgctgcccagtgctgagaaagatatgtgcctgtcggactccaacaaaggcatgctaggcctcattgtgtacctgggcatgatggtgggggccttcctctggggaggcctggctgatcggctgggtcggagacagtgtctgctcatctcgctctcagtcaacagcgtcttcgctttcttctcatccttcgtccagggttatggcaccttccttttctgccgcctcctttctggggttgggattggtggttccatccccattgtcttctcctatttttcggagtttctggcccaggagaaacgtggggagcatttgagctggctctgtatgttctggatgattggtggcgtgtatgcagctgcaatggcctgggccatcatcccccactatgggtggagtttccagatgggctctgcttaccagttccacagctggagggtctttgtcctcgtctttgcctttccctctgtgtttgccatcggggctctgactacgcagccggagagtccccgcttcttcttagagaatgggaagcacgatgaggcctggatggtgctgaagcaggttcatgacaccaacatgcgagccaagggccatcctgagcgagtcttctcagtaacccacattaaaacgattcatcaggaggatgaattgattgagatccagtcagacacaggaacctggtaccagcgctggggagtgcgggctttgagcctggggggtcaggtttgggggaacttcctctcctgcttcagtccagagtaccggcgcatcactctgatgatgatgggggtatggttcaccatgtccttcagctactacggtttgactgtctggtttcccgacatgatccgccatctccaggctgtggactatgcagcccgaaccaaagtgttcccaggggagcgcgtggagcacgtgacatttaacttcacactggagaatcagatccaccgagggggacagtacttcaatgacaagttcatcgggctgcgtctgaagtcagtgtcctttgaggattccctgtttgaggaatgttactttgaagatgtcacatccagcaacacattcttccgcaactgcacattcatcaacaccgtgttctacaacacggacctgtttgagtacaagttcgtgaacagccgcctggtgaacagcacattcctgcacaataaggaaggttgcccactagatgtgacagggacgggcgaaggtgcctacatggtgtactttgtcagcttcttggggacactggctgtgctccctggaaatattgtgtctgctctgctcatggacaagattggcaggctcagaatgcttgctggttccagtgtgttgtcctgtgtttcctgcttcttcctgtcttttgggaacagtgagtcagccatgatcgctctgctctgcctttttgggggagtcagtattgcatcctggaacgcgctggacgtgctgactgttgaactctacccttccgacaagaggacgacggccttcggcttcctgaatgccctgtgtaagctggcagctgtactgggcatcagcatcttcacgtcctttgtgggaatcaccaaggccgctcccatcctcttcgcctcagctgcgcttgcccttggtagctctctggctctgaagctgcctgagacccggggacaggtgctgcagtgagggatgggggagtgtctcaggggctttagggatggcaggcacactgtgaccaataatttcttttatccctaccctgccctgctgtcctggtcctactccgtgtttggtgtcttagctgtgtgcctgtgtgcatgtgtgtgaccctgacgggcaggggctacggggagggtccctttgtcccatgtttgggaggagggactccccacctgctgccaccctcaactttgcacaaggagaaggctgagctgcatccttctctccctcagtgttagcaggggtggggacgactgtttctctgctccaggtgttccagaatttctgcctttcccatcattccctccgcctaggccctggtgaaccacaggtatggagttatagtgggggctgaggcttggaccaaaagaacttcttgagtgggagcctcccaaggatgctggggagtagcaataaaccttagcctccgttttcacctcaattcaggctacaagtgtgaagcctggattttatggaattagttttctgattcttatttatatgtaagttctgaggcagcttagctggactgtgtgtggatgtatacatacactcatatgtgtgtgtgtgtgcgccgcgtgcgtgtgcgtgtgtgtatgtgtgccatggggtaggggtaccactatactgttcaattataagccaagagtagtagtttcagtgagcacacacacaacactgtttttctatcgtaactcccagaatcttgtacctgtgttggggctgcaggcagaagtccttggtcaggctggggtgagccctgcaatcttgggggacctgagggcacctgacaaggactttctccttcctctagagaggttctacccactagccacagccctcccatctgacctgtccacacaggcagtgtatcagaggaaagaaagggaaaataaccaggcacacatggtcaaaccagcaggtctgaaagcacaagaagctggggcaggggcaggaagcaggggtccatcccctaacccttctcaaaaaggctgggtcgtgagggacccctaatgcagggacctgaagcctcagtttccccatcttgcccttccacagaacagcctctgtaggtagagctgccccccgtcctaccctactcttgtggctgctttctttggtactcttcccactcccaccgtagctgtgacgtgttgtagtttttagctgtttgtaaaatgtt

SEQ ID NO: 2077 - DNA, 432 bp, Rattus norvegicus
  Genbank Accession No. NM_078617
atgggtaagtgtcgtggtctccgtactgcccggaagctccgcagtcaccgacgggaccagaagtggcatgataagcagtacaagaaagcccacttgggcacagccctgaaggccaatccgtttgggggtgcctctcacgcaaagggaattgtgctggaaaaagtaggggttgaagccaaacagccaaattctgccatccggaagtgtgtcagggtgcagctcattaagaacggcaagaagatcacagcgttcgtgcccaatgacggttgcttgaacttcattgaggaaaatgatgaagttctggttgctggatttggtcgcaaaggccatgccgtgggtgatattcctggagtccgctttaaggtggttaaagtagccaatgtgtctcttttggctctgtacaaaggcaagaaggaaagaccaagatcataa

SEQ ID NO: 2078 - DNA, 1107 bp, Rattus norvegicus
  Genbank Accession No. NM_080399
aaggcatttcaacatcaatattattctattagtccagtagatagtagctaagtttcaaattctgtgttaatcaaaatttaaaaatatgattaagtcatattaggattacaacaaagagatgtaatctttaaagtctaccaatacatttaaatgagcagtatacagtatgtactaaataccatgccaggaaatggagaaaatgtactgtatttatagagtatattgaaaagttctgggagaaatttagatatgagctctatcttcgcacatttcagaaaataaggttaacagcaaacaggtattgctgtttatagataatctatgactgtaaagtttgtatggatttagaaattaaattagccttcagcgtctggtgaaatcccgcagcgtctagggaaagatccgttctgctccgcgagggaaacagagccgttgaccatggttgcaacgggcagtttgagcagtaagaacacggccagcatttcagagttgctggacggtggctctcaccctgggagtctgctaagtgatttcgactactgggattatgtcgtccctgagcccaacctcaacgaggtggtgtttgaagagacaacatgccagaatttggttaaaatgttggagaactgtctgtccaagtcaaagcaaaccaaactcggttgctctaaggtcctggttcctgagaaactgacccagagaattgcccaagatgtcctgcggctctcatccacagagccctgcggccttcggggctgtgttatgcacgtgaacttggaaattgaaaatgtgtgtaaaaagctggataggattgtgtgtgatgctagtgtggtgccgacctttgagctcacgctggtgttcaagcaggagagctgctcctggaccagcctcaaggacttcttctttagcggaggtcgcttctcgtcgggccttaggcgaactctgatcctcagctcgggatttcgacttgttaagaaaaaactgtactctctgattggaacgacagtcattgaggagtgctgaggaggaaaaaacaattaaaggtccctaatgagtggctaataaacctctggagctatccagcaaaaaaaaaaaaaaaaaaaaaaaaaa

SEQ ID NO: 2079 - DNA, 5174 bp, Rattus norvegicus
  Genbank Accession No. NM_080581
gggttgagctgaactgagatcccaagaccagcggtgcaccagagccacatggaccgcttgtgcggctccggggagctgggctccaagttctgggactccaacctgactgtatataccaacactccagacctcacaccctgtttccagaactccttgctggcctgggttccctgcatctatctgtgggctgccttgccctgctacctgttctacctgaggcaccatcggcttggctacatagtcctctcatgcttatccaggctcaagacggccctcggtgttctgctgtggtgtatctcatgggtggacctgttctactccttccatggcctggttcacggctcatcccctgctcctgtcttctttatcacacccttgttggtggggatcaccatgctgctggccacattgctaatccagtatgagcggcttcggggcgtgcggtcttcaggtgtgctcatcatcttctggctcctgtgtgtgatctgtgccatcatccccttccgttccaagatcctcttggctttggcagagggtaaaatcttggatccgttccgattcaccactttctacatctacttcgccctcgtgctgtgtgccttcatcctgtcctgcttccaggagaagccgcctttgttttccccagagaatcttgacacaaatccttgcccagaggccagcgctggcttcttctcccgtctgtctttctggtggttcacaaagcttgccatccttggctaccgacgtcccctggaggacagtgacctctggtctctgtctgaggaggactgctctcacaaggtggtacaacggctactggaagcatggcaaaagcagcagacccaagcatcagggccccagactgcagcccttgagccaaagatcgcaggtgaggatgaggtcctgctgaaggcccgccccaagaccaagaagccttcctttctgagggctttggtgagaaccttcacctccagcttgctcatgggtgcctgcttcaagctgatccaggacctgctctccttcatcaacccacagctgctcagcatcctcatcaggtttatttctgaccccacggcccctacctggtggggcttcttgctggccggactgatgttcgtgagctccaccatgcagacattgatcttacaccaacattaccactgcatctttgtgatggccttgaggatacggactgctatcataggcgtcatctacaggaaggctctgaccatcaccaactcagtcaaacgtgagtacactgtgggagaaatggtcaacctcatgtcggtggacgcccagcgcttcatggatgtctccccattcatcaacctgctgtggtctgcacctttgcaggtcatcctggcgatatacttcctctggcagatcttaggcccatcagccctggctggggtggctgtgatagtcttgctgataccactcaatggagctgtgtccatgaaaatgaagacctaccaggtacagcaaatgaagttcaaagactcccgcatcaaactgatgagtgagatcctgaatggcatcaaagttctgaagctgtacgcttgggagcccaccttcttggagcaggtagaaggaatcaggcagggtgagctccagctactgcggaagggcgcctacctgcaggctatctctaccttcatctgggtctgcaccccgtttatggtgaccctgatcaccctcggggtgtacgtgtgtgtggacaagaacaatgtgctggatgctgagaaggccttcgtgtccctgtccttgttcaatatcttaaagatccccctcaacctgctgcctcagttaatcagtggcatgacccagaccagcgtgtctctgaaacggatccaggatttcctgaaccaagatgaacttgacccccagtgtgtggaaagaaagaccatctccccaggccgtgccatcaccatacacaacggcaccttctcctggtccaaggacctgcctcccacccttcacagcctaaacattcaaatcccgaagggggcattggtggctgtggtgggacctgtgggctgtgggaagtcttccctggtgtctgccttgctcggagagatggagaagctggaaggtgcagtgtctgtaaagggctctgtggcctacgtgccccagcaggcgtggatccagaactgcacacttcaggaaaatgtgctatttggccaacccatgaaccccaagcgctaccaacaggctctggagacgtgtgccctgctagctgacctagatgtgcttcctggtggggaccagacagagattggagagaagggcattaacctatctggaggccagcgacaacgggtgagtttggcccgagctgtttatagtgacgccaacatttttttgctggatgacccactgtcggctgtggactctcacgtggctaagcatatcttcgaccaagtgattggaccagaaggtgtgctggcaggcaagactcgggtgctggtaacccatggcatcagcttcctgccccagacggactttatcattgtgcttgctgacggacagattactgagatgggtcactactccgaactcctgcagcacgatggctcctttgccaacttcctccgaaactatgcaccagatgaaaaccaggaggccaatgaaggagtcttgcaacatgcaaatgaggaggtgctcctgcttgaagacacactcagcacccacacagacctgacagacaccgagccagccatatacgaggtccgcaagcagttcatgagagagatgagctccttgtcttctgaaggagagggccagaaccggcctgtgctcaagagatatacgagttcactggagaaggaggtgccggcgacacagactaaagagactggtgcattaatcaaagaggagatcgcagagacaggcaatgtgaagctgagcgtgtactgggattatgccaagtctgtggggctctgcaccacgctgtttatctgcctcctgtatgctggccaaaatgcggttgctatcggagccaatgtgtggctcagtgcctggaccaatgatgtggaggaacatggccagcagaacaacacctccgtaaggctgggagtctacgccaccctaggaatactgcaagggctcctggtcatgctgtcggccttcaccatggtggttggcgctatccaggctgcccgcctgctgcacacagctctgttgcacaaccagatccgtgcgcctcagtccttctttgacacgacgccctcaggccgcatcctcaatcgtttctccaaggacatatacgtcatcgatgaggttctggcccccaccatcctcatgctgttcaattcattctacacatccatctccaccattgtggtcatcgtggccagcacgccactcttctgcgtggttgttcttcctctggctgtgttctatggcttcgtgcagcgcttctatgtggccacatcgaggcagctgaagagactggaatccgttagccgctcgcccatcttctcccacttctcggagacagtaactggcaccagtgtcattcgggcctacggccgagtccaagacttcaaggtcctcagtgatgctaaggtggatagcaaccagaagaccacttatccttacatcgcctccaaccggtggctgggtgtccacgtggagtttgtggggaactgcgtggtgctcttctccgcgctgtttgcagtgatcgggagaaacagcttgaatccagggcttgtgggtctttccgtgtcctatgccttacaggtgaccttgagtttgaattggatgatacggacgctatccgacctggagtctaatatcatagccgtggagagagtcaaggagtactctaagacggagactgaggctccctgggtgttggagagcaaccgtgctccagaaggctggcccaggagtggggtggtagagttccggaactattcggtgcggtaccgcccgggcctcgagttggtgctgaagaatttgactctgcatgtgcagggtggggagaaggtaggcatcgtgggccgcactggggctggcaaatcttccatgactctttgcctattccgaatcctggaggccgcagagggtgagatcttcattgacgggctcaatgtggcacacattggcctccatgacctgcgttcacaactcaccatcatccctcaggaccccatcctgttctcgggcacgctgcgcatgaacctcgatccctttggccgttactcggacgaggacatctggaggaccctggagctatcccacctgagtgcatttgtgagcagccagccgacaggcctggattttcagtgctctgagggtggggataatctcagtgttggccagaggcagctcgtgtgcctagcccgagccctgctccgaaagagccgtgtcctggttttagacgaggccaccgctgccattgacctggagactgatgacctcatccagggtaccatccgtacccagtttgaagactgcactgtactgaccatcgcccaccggctcaacacaatcatggactacaaccgggtcctggtcttggacaaaggagtagtagctgaatttgattctccagtaaacctcattgcagctggaggcatcttctatgggatggccaaagatgcaggactcgcctagaatctgcattccaaaggtttcttccttgtctgaatcggacagcaagtagctgcagcatggatttgatggcaacgagtggggacatttgagttggttttggtttttttttgttttttgttttttttttttttttaaattctgcaaattgccttacagactagccatacttaacagtggaatgaggaagtgggtccttggaggtcacagccagttcacagccaagttcagaccagtccctgggtctcctagacctagtctaccattattcccgtactgcatttttttttggttctttttttcagagctggggaccgaacccagggccttgcccttcctaggtaagcgctctaccactgagctaaatccccagcccccgtactgcagtttttaagagaccctgctcctgcctctacatattcatagtttccaattttttttttaaatgagcctttctccttctggaccagggactgctaggtcagtctgtccggggaacagaatccctggttggtgctgtctgaatccactgacgaaataaagccatgagcagcagc

SEQ ID NO: 2080 - DNA, 1505 bp, Rattus norvegicus
  Genbank Accession No. NM_080585
  misc_feature (1)..(1505): n = a or c or g or t
gtagcttggctgtgtcgggcctgaaccgagcagctgcgcgacgtcatggacacctccgggaagcaggctgaggctatggcgctgctggctgaagcggagcgcaaggtgaagaactcgcagtccttcttctccggcctctttggaggttcatccaaaatagaggaagcatgcgagatctatgccagagctgcgaacatgttcaagatggccaagaactggagcgctgctgggaacgctttctgccaggctgcccaactgcacctacagctccagagcaagcacgatgcagccacctgctttgtggacgccggcaacgctttcaagaaagctgacccccaagaggccattaactgtctgatgagagcaattgagatctatacagacatgggcagattcacaatcgcagccaagcaccacatctccattgctgagatctatgagacagaactggtggatgtagagaaggccattgcccactacgagcaatctgcagactactacaaaggagaagagtccaacagctcagccaacaagtgtctgctgaaggtggctggctacgccgcacagctggagcagtaccagaaggctatcgacatctatgagcaggtggggaccagcgccatggacagtcccctcctcaagtacagcgccaaagactacttcttcaaggcggccctttgccacttctgcatcgacatgctgaacgccaagcttgctgttcagaagtatgaggagctgttccctgccttctcggattcccgggaatgcaagctgatgaaaaagctgctggaagcccatgaggaacagaatgtggacagctacacagagtcggtgaaggaatatgactccatctccagactggaccagtggcttaccaccatgcttctacgaatcaagaagaccattcagggtgatgaggaagacctgcgctaggcctccagccactgccttccacccatctgtctgtcacagaggtggagccaacacctccaccaggagtctgaaggagtgggtncaatgtaggcctcatcctccagggcaccaggcaagctctcctggatggctggtcaccctatgcccactgcgtccttcaccccgccatttatttaagctcccaaaggtgtcctcctgctctggaaaacccacctggacagattctccaatacagacttctctgtgtgcttcaggaacctggagtcagcatccagtcccatctcctgaccagcagtgtactaaggctatttccatatctcctaccttgtaccctagcagagataagaacacaggtagttcgtgagacttgctctccctggctgggggtagcctctgcccctggagctttcccttgttcctacaatgccaacctctcaggttagacccagccctggagctcacagggtgccttggccctgccctgccctgcacctgcttctctcgctgcatccaggtctgtctgtcgacntgaagctgcggctggcccaagaaagacaannacctgccacnng

SEQ ID NO: 2081 - DNA, 3350 bp, Rattus norvegicus
  Genbank Accession No. NM_080766
cgggtggggccggaagtgccgctcccgggtgggggctgttcatggcggtttcggggtctccaacagcttctcaggttgaaatccaaaagcctcccgaggcgggtctgcggagtttgagatttttgcaggtgtgaaatgactgagtacaaactggtggtggttggagcaggtggcgttgggaaaagtgctttgacaatccagctaatccagaaccactttgtggatgaatatgatcccaccatagaggattcttaccgaaaacaagtggtgattgacggtgagacctgtctactggacatactggacacagctggacaagaggagtacagtgccatgagagaccaatacatgaggacaggcgaagggttcctctgtgtgtttgccatcaataatagcaaatcctttgcagatattaacctctacagggagcaaattaagcgggtgaaagactctgatgatgtacccatggtgctggtagggaacaagtgtgacttgccaacaaggacagttgacacaaagcaagcccacgagctggccaagagttatggaattccattcattgaaacctcagccaagacccgacagggtgtggaggatgccttttacacgcttgtaagggagatacgccagtaccggatgaagaagctcaacagcagtgaggatggcactcaaggctgtatggggctgccctgtgtggtgatgtagtaagaccctttaaaagttctgtcatcagaaacgagccactttcaagcctcactgatgccctggttctgacatccctggaggagacgtgtttctgctgctctctgcatctcagagaagctcctgcttcctgcttccccaacttagttactgagcacagccatctaacctgagacctcttcagaataactacctcctcactcggctgtccgaaccagagaaatgaacctgtttctccccagtagttctctgccctgggtttcccctagaaacaaacacacctgccagctggctttgtcctccgaaaagcagtttacattgatgcacgagaaccaaactatagacaagcaattctgttgtcaacagtttcttaagctctaaggtaacaattgctggtgatttccccctttgcccccaactgttgaacttggccttgttagttttgggggaaatgtaaaaattaatcctcttccccgagaatagaattagtgttgctgattgcctgatttgcaatgtgatcagctatattctataagctggcgtctgctctgtattcataaatgcaaacatgagtactgacgtaagtgcatccctagtcttctcagctgcatgcaattaaatccaacgttcacaacaaagtgccttgtcctaacagtgctctgtaggcttccgttatagttcgtattgaaatagatgtttcaagaaccattgtataggaaagtgactatgagccatctaccttggagggaaaggtgaatctacctgatggcagatgcttgtatatgtacacatatgtacacaaagacagtttccctgtttgcggttctcccaggagaaagagggaactgaaacgattatgactaatttcatttaattctagctaatctttttttttttttttggagggggggagtaggttaccacctataaatatttgtaatttcttctagcttactgataatctaatagtcaatgagcttccattataataaattggttcataccaggaagccctccatttatagttagtcagatactgtaaaaattggcatgttattactttatacctgtgattaatgattcttcaaaccttaaatatagttattgcaggcaggttatatctttgctgcatagtttcttcatggaaaaaaaaaaatatatatatatatggagagagtggccctcagttcccatctcaccatccctctctttcagcctagatcagttcaagcatcctataggagcttgaataattatctcagttgaacaaaccatggtgctaatggaccaggtcatggtttcaaaacttgaacaagccagttagatcacagagaaaacagttcatccatatttgcctccctgcctattactcctgcttgtagacttttgcctgatgcctgctgttcgagctataaggataaaagttagtgtggttctacaccaggactgggaatgcctggtgagctgttgggtaagcctagacacctttacattttcagacccgtatttttagccccatggaaactgaagccagagttcacacctccatctcttcccccattagataaatgttcttaatctatatagctttttaaaagtatttaaaacatgtctataagttaggctaccaactaacaaaagctgatgtgtttgttcaaataaagaggtatcctttactacttgagaaaagaatgtaaaatgccattaattgttgtcatgtagaagtttgatatttgtggtaatgccctgataattcattggtgagtttgttagtcatggtgatacttaaaatataactcatctcagtaatttcaatgaaaacataaaatgggatgccttgattgaaaaaagcaaacctaattccaaaatgaccattttctcttctgatcttacgacacctaaaaatctgagatccttgggattcatttgtttataacaggaacttgctatgtaatcttggctggcctcaaactcacaatgctcttcctgcatcagtctccaaaatgatgggattacaggcacatgccaccacacacacctgatctggtttctaatgaatttttattgttaagcaaatccccatcaccttgaaactaatcagaagagggaagaaacatatgttgtgctcctcagtgctaatgctgggatctttcaccaggggtttgcattcttaagtaaactgctgcctttttacaacataggctcagtcatcctcctgaagctgcttgagaccaacacttggtcttgttcttttttaatgtgtctgtatgactggtggtggatctctaaaaagtttattaaactccagttagggagaaagttactccccttggcccttttgaccatatccatgtgtgtgtgtgtgtgtgtgtgtgtgtgtgtgtgtgtgtgtgtacacacatatgtatgtatgtgtgtctgtagttggtctccagttcagatgcccttactagcatatattcccacagggtgtgggtttcggcacaacagtgacaaacttgaaagccaagtaaatccagttggtgtttttagagagcataattagtgaagatctggtttacctcaaagtcacaaagcctctcttcctgaattgaagtgcctggcccactgtcacaaattaacatgtggaaggcagctggttgaagctt

SEQ ID NO: 2082 - DNA, 1572 bp, Rattus norvegicus
  Genbank Accession No. NM_080778
caaaaaggaaaaactaactaacctcaatcaactagccctgagccacccggggcgccctcccgcgccctctcgcaccctcgcacacacaaaaggcggcgcgccggagcccgagacccgggagccgccgccaccccgccgccgcccgcagccaggggagcagaagtccggacgcggcccccatagatatggcaatggtagtcagcacgtggcgcgacccccaggacgaggtgcccggctctcagggcagccaggcctcgcaggcgccgcccgtgccgggcccgccgcctggcgccccgcacacgccacagacgccgggccaagggggcccggccagcacgccggcccagacagcggctggcagccagggcggccctggcggcccaggcagcgacaaacagcagcagcagcagcacatcgagtgcgtggtgtgcggggacaagtcgagcggcaagcactacggccagttcacgtgcgagggctgcaagagcttcttcaagcgcagcgtgcggaggaacctgagctacacgtgccgcgccaaccggaactgtcccatcgaccagcaccaccgcaaccagtgccagtactgccgcctcaaaaagtgcctcaaagtgggcatgagacgggaagctgtacagaggggcaggatgccgcccacccagcctactcacgggcagtttgcactgaccaacggggaccccctcaactgccactcgtacctgtccggatatatttccctgctgctgcgcgcggagccctaccccacgtcgcgcttcggcagtcagtgcatgcagcctaacaacatcatgggcatcgagaacatttgcgaactggccgcacggatgctcttcagcgccgttgagtgggcccggaacatccccttcttccctgacctgcagatcacggaccaggtggccctccttcgcctcacctggagcgagctgttcgtgttgaatgcagcacagtgctccatgcccctccatgttgccccgctccttgccgctgctggcctgcacgcttcacccatgtcagccgaccgggtggtcgcctttatggaccacatacggatcttccaagagcaagtggagaagctcaaggcactgcacgtcgactccgccgagtacagctgcctcaaggccatagtcctgttcacctcagatgcctgtggtctgtctgatgtagcccacgtggaaagtttgcaggaaaagtcccagtgtgctttggaagagtacgttaggagccagtaccccaaccagccaacacggttcggaaagcttttgcttcgtctcccttccctccgcacggtctcctcctcagtcatagagcaattgtttttcgtccgtttggtaggtaaaacccccatcgaaaccctcatccgggatatgttactgtccggcagcagttttaactggccatacatggcaattcaataaataaataaatcaaaataagggggagtgaaacagagaaagaaaaggcaaaagactggtttttgtttgcttaatttccttctgttaagaaaggatgttacaagtttgctaaaagaagagaggggaagaacttaatggactttga

SEQ ID NO: 2083 - DNA, 495 bp, Rattus norvegicus
  Genbank Accession No. NM_080782
atgtccgatcctggtgatgtccgacctgttccgcacaggagcaaagtatgccgtcgtctgttcggtcccgtggacagtgagcagttgagccgcgattgcgatgcgctcatggcgagctgtctccaggaggcccgagaacggtggaactttgacttcgccactgagacgccactggagggcaactacgtctgggagcgtgttcggagcccagggctgcccaagatctacctgagccctgggtcccgccgccgtgatgacctgggaggggacaagaggcccagtacctcctcggccctgctgcaggggccagggccagctccggaggaccacgtggccttgtcgctgtcttgcactctggtgtctcacgcccctgagaggcctgaagactccccgggcgggaccgggacatctcagggccgaaaacggaggcagaccagcctaacagatttctatcactccaagcgccgattggtcttctgcaagagaaagccctga

SEQ ID NO: 2084 - DNA, 1061 bp, Rattus norvegicus
  Genbank Accession No. NM_080887
tctctgtgacgatggtgggagtgaagccggtcgggagcgatccagatttccagccggagctgagtggggcgggctccagacttgctgtggtcaagttcaccatgagagggtgtggaccatgtttgaggatcgccccggcattcagttctatgagtaataagtacccacaggcagtcttcttggaagtagatgtgcatcagtgccagggaacagctgccaccaacaatatatcagcaacacctacatttttgttttttcgaaacaaagtgagaattgatcagtatcaaggagcagatgctgtgggactggaagaaaaaatcaagcagcatttagaaaatgaccctgggagcaatgaggacacagacattcccaagggctatatggatttaatgccttttattaacaaagctggctgcgaatgtctcaatgaaagtgatgagcacggctttgacaactgcttacgaaaagacctgtccttcttggagtctgactgcgacgagcagctgcttattactgtggcattcaatcaaccagttaaactttattccatgaagtttcaaggaccagataatggtcagggtcctaaatatgtaaaaatttttatcaacctaccccgatctatggactttgaggaggcagaaaggagtgagccaacccaagctctggaactgacagaagatgacattaaagaagatggcattgttcctcttcgttatgttaaatttcagaatgtgaacagtgtaactttgtttgttcagtctaatcaaggagaagaagaaacaacaagaatttcctattttactttcattggtactcccgtccaggcaacaaatatgaatgacttcaaacgagtagttggcaaaaagggggaaagccattagggtacttttgacactggaagactactgcagtcaaatttgcagctcctggataattgcttgattctcttcggaaactgttaatcttttatttgttgccagtaccaataaatcattgcttttgttcagatggtaatactagtgtttctattgtaatcttgatacatgcagttgtaaataaaa

SEQ ID NO: 2085 - DNA, 1685 bp, Rattus norvegicus
  Genbank Accession No. NM_080892
tctctgctgaacctttgtccattcctagcaaatcctgcaggaccagagtgtcagccagcagcatggctacaaaatgcacaaagtgtggtccaggttatgcgacccctctggaggccatgaaaggaccccgagaggagattgtctacttgccctgcatttaccgaaacacaggcattgaagccccggattatttggccacagtggatgttgaccccaagtctccccattatagccaggtcatccataggctgcccatgccacacctgaaggacgagctgcaccactcagggtggaacacctgcagtagctgctttggggacagcaccaagtcacgcgacaagctgatactgcccagcatcatctcctcccgcatctatgtggtggatgtgggctctgagcctcgtgccccgaagttgcacaaggtcattgagcccaatgaaatccatgccaagtgcaacctgggcaatctgcacaccagccactgcctggccagcggagaggtgatgatcagctccttgggggatccccaggggaatggcaaagggggttttgtgctgctggatggggagaccttcgaggtgaaagggacgtgggagaagcctgggggtgaagctccaatgggctatgacttctggtaccagcctcgacacaacatcatggtcagcactgaatgggcagctcccaatgtcttcaaagatggcttcaaccctgctcatgtggaggctgggctgtatgggagccacatacatgtgtgggactggcagcgacatgagattatccagaccctgcaaatgaaagatgggctgatccccctggagatccgcttcctgcacgacccagatgccacccagggctttgtaggctgcgccctcagctccaacatccagcgcttctacaagaatgagggaggcacctggtcagtggagaaggtgatccaggtgccctccaagaaagtgaagggctggatgttgccagaaatgcctggtttgatcaccgacatcttgctgtccctggatgaccgcttcctctacttcagcaactggctgcacggggacattcggcagtatgacatctctaacccgaagaagcctcgcctcactgggcagatcttccttgggggcagcattgttaaaggaggctctgtacaagtgctggaggaccaagagctaacgtgtcagccggagcccctagtggtcaagggaaaacgagttcctggaggtcctcagatgatccagctcagcttagatgggaagcgtctttacgtcactacatcactgtacagcgcctgggacaagcagttttaccctaatctcattagggaaggctctgtgatgctgcaaattgatgtagatacagcaaatggagggctgaagttgaaccccaactttctggtggactttgggaaagagcctcttgggccagcactggctcatgagcttcgttacccagggggtgattgcagttctgacatctggatctgaaggctagccctaaaggccttcctccacagtcggggtcctccttctgaggagcctagcttcgctctgctctgggtcccaactctccaaggccatgatgagaccatcgagaactgcagagcagtatctcactactaccttgcttgttgtttgtgccattcttaagtgagctcctggaagcaccaagaaataaaatgctgaaccttt

SEQ ID NO: 2086 - DNA, 355 bp, Rattus norvegicus
  Genbank Accession No. NM_080902
gaaaccggcaggactggaagggacgtctcctctccgaagactcttcaagaaatcacaatgtcaaccaacacagaccttcctctctcttcatacgatgaaggtcaggggtccaagtttattcggaaagctagggagacaccgtttgtccccattggaatggccggcttcgcagcgattgttgcatatgggctctacaagctgaagagcaggggaaacacgaagatgtctattcacttgatccacatgcgtgtggcagcccagggctttgttgtgggggccatgactcttggtatgggctattccatgtatcaagaattctgggccaagcgtaagccttagaagagctggtggcatg

SEQ ID NO: 2087 - DNA, 816 bp, Rattus norvegicus
  Genbank Accession No. NM_130401
ctgaggcagcccagactgttctccagctgatctcatacaaacactccagacctccagcagccccaggagtcaaaacaccagcggctctacagctgcctgcagccatgttggccctcagtctgctcgcgctgggtctgctcgccgaagtggcacctgccagctgtcaacaaggtctagggaaccttcagccctggatgcaaggcctcattgctgtcgctgtgttcttggtccttgttgcaatcgccttcgccgtcaaccacttctggtgccaggaagagcaggaacctgggagcacgatgatgatcactggaaacaaggccgatggggttctggtgggcatggatggcagatactcttcaatggcatctggttttaggtccagtgagcacaagaatgccttcgagaatgttctggaggaagagggcagggtccgcagcacacccatgtgaccagctcctctatggccctagtccccaggctacagggaatgtggagttgatgcctaccatctcacccagccactgttctacaggaatctattgaaacaagctgacctctcacctctcttgaatcacagccatctcaggctaggactcagaccaagctgagcacagcttatgctgtggcccgggggttccctggggtcttccagccagttctgaggagctttgtaaagagacgcctggctcagctcctcccctccctgctcctcctgcaactatggaagtggctcttatttctgtgaaataaagactttttatacttctgggaaaaaaaaaaaaaaaaaaaaaaaaaaaaaaaaaaaaaaaaaaaaaa

SEQ ID NO: 2088 - DNA, 1386 bp, Rattus norvegicus
  Genbank Accession No. NM_130411
atgagccggcaggtggttcgctccagcaaattccgccacgtgtttggacagccagccaaagctgaccagtgctatgaggatgtgcgcgtctcacaaaccacttgggacagtggcttctgcgctgtcaaccccaagttcatggctctgatctgtgaggccagtgggggaggggccttcctggtgctacccctaggcaagactggacgagtagacaagaatgtgcccctggtgtgcggccacactgcccctgtgctagacatcgcctggtgtccacacaatgacaacgtcattgccagtggctctgaggactgcacagttatggtgtgggagatcccggatgggggcctggtgctgcccttgcgggagcctgttgtcaccttggagggccacaccaagcgggttggcatcgtggcctggcaccccacagcccagaatgtactgctcagcgcaggttgtgacaatgtgatcctggtgtgggatgtgggcactggggcagccgtgctgacgctgggcccggatgtgcacccggacacaatctacagtgtggattggagccgggatggtgctctcatctgtacctcctgccgtgacaagcgtgttcgcgtcatcgagcctcgcaaaggcactgttgtggctgagaaggagcgtcctcatgagggaactcggccagtgcatgctgtgtttgtgtcagaagggaagattctaaccacggggttcagtcgcatgagtgagcggcaggtggcgctgtgggacacaaagcacctggaggagccactgtccctgcaggagctggacacaagcagtggagtcctgctacctttttttgaccctgataccaacatcgtctacctctgtggcaagggtgacagctctatccggtattttgagatcacgtctgaggctccgttcctgcattatctttccatgttcagttccaaggagtctcaacgtggtatgggctacatgcccaaacgtggcctggaagtgaataagtgcgagattgccagattctataagcttcatgagcggaaatgtgagcctattgccatgacagtgcctagaaagtcggacctgttccaggaggacctgtatccacccactgccggacccgaccccgccctcacagctgaggagtggctgagcggtcgtgatgctggccccctcctcatttccctcaaggatggctacgtgcccccaaagagcagggagctgagagtcaacaggggcctggacagtgctcgcagaagagctacaccggagcccagtagcactcttagctcggacaccgtgtcacggctggaggaggatgtgaggaatctcaacgccatagtgcaaaagcttcaagagcgcctggacaggctggaggagactgttcaggccaagtag

SEQ ID NO: 2089 - DNA, 2912 bp, Rattus norvegicus
  Genbank Accession No. NM_130416
aagctgaatcgaattcggcacgaggcagggtcccgcccgggcttgggggcggtccaggcagccagcatcctcgcgccgcccatgcgccacgccctccggccctccctggctccatattgcaggaaagcgggctagggtgtgacgctgctttctggttcagaatgtcatacccaggctaccccccgacaggctacccacctttccctggatatcctcctgcaggtcaggagtcctctttccccacttcgggtcagtatccgtaccctagtggctttccaccaatgggaggaggtgcttacccaccagctccaagtggtggctacccaggagctggaggctacccctcacctggaggttatccagcccctgggggctatcctggaaccctaaatccagggggtcctccatcctatcctggaggtcaaggctttggggccccacctggtggggcaggcttttctggctatccacagccacctgcacagtcttacggcggtggaccagcccaggttccagtcccaggtggctttcctggagggcagatgccatctcagtaccccggaggacagtctccctaccctggccagcctgctgcgatgactcagggcacccaaggaacaatccgcccagccttcaacttcgatgctatgagagatgcagagattctccgcaaggcaatgaaggggtttgggactgatgagcaagcgattgtggatgtcgtgtctaaccgttccaatgaccagaggcaacaaattaaagcagcttttaagaccatgtatggcaaggatttaattaaagatctcaagtcagagttgagtggaaacatggaagaattaatccttgccctgttcatgcctcctacatactatgatgcctggagtttgcggaaggcgatacagggagcaggaactcaagagcgtgtgttgatagagattttgtgcacaagaacaaatcaagaaatccgagacattgttagatgctatcaattagaatttggacgcgagctcgagagggacattagatcggatacctcaggacatttcgaacggctcctcgtgtccatgtgccagggaaaccgtgacgagagcccaagtataaaccaccagatggcccaggaagatgcccagcgcctctatcaggctggggaggggaggctagggacagacgaatcctgtttcaacatgatcctcgccacaaggagcttccctcagctgagagccaccatggaggcttattccaggatggctaatcgagatttgctaagcagtgtgagccgggaattttccggatacgttgaaagcggtttgaagaccatattgcagtgcgccctcaaccgccctgccttcttcgccgagcgactctactattccatgaaaggcgctggaacagatgactccaccctggtcaggattgtggtcactcggagtgagattgacctcgttcagataaaacagatgttcacccagatgtatcagaagactctaagcacgatgattgcaagtgacaccagtggagattacaggaagctgctcctggccatcgttggccagtgacggggatttttttccctttaaggaatgaagctcttcagggcctatctttctgagcaatgagacctgcatgcagccacgtcagacaccaactgaccagagtgcttttccactgaggcctgtcagggggtgtgctgcgtttgcacatgttgtcactgccttaattctaatgttagtctctttctttctgtatccaatcagtgtaaaagccatgtcaatgacatagtaatgtaaatttgtaaagcttcactcccactgctttcactttaatccggatttcaaattaaaaaaaaaggattcaaattaatgaaaaattcacagcaatctctaattctgtgtaacgttaaaagaatgagagaatgagaacggtgttcattctcattaaaacatgccgttctggtttgattgcagaaggtgatattcagttcaggaataagcctccgtgactcacatccatggctaaagtttcctggtacaaagggaataaatctgtctcagctagtaatagtgcaggacggaaaggccatgtggtgttcccctaaatacgacagtctatgcaggcaagcttctcggaggttctggaaatgtcacttggtgttcttgagacccctttccatcccaaggccagcagttgtcagccgttagtaacgcaccacactgtgtggtaggagtgccttgaacaccacacagctctgacagtggtgtcctgtacaaggctggccctcgtggtaaccagcatgtccctgagaccatcgagagcttaactggaagcaggggaaagctcctcctcttcctcctccccctcttcttcctcttcctcctccccctcctcttcctcctccctttattttttcttctttccttccttcttcttcctcatttcctcctttttttctcccccatagcccaggtctttgagtaacctgattacttctgtgttcctacccagtccagtgaatgaggaaaaggcaagcccattttacatttaattgccacaaggaaaattacctttaaaagcctcgttttttggtcttttaacaacaaatcttatgtcgtacgagtggtttgcctgcgttacatgcacatgcacccaaccacttgcatgcctattttcctgaggaggccaggagaggttttggaaaccctgaaatggagattatagatgcttgtaaactagccactcagtgctggcatcggaacccaggtcctctgtgtttggtttattagaatagaaaagtgaaaagctatagtctgagctttgattttaagataaatgtttaaacagtctggtctcatgactttacagaaacaataaaattgtataatacttctttaaaaccacaaaaaaaaaaaaaaaaaaaa

SEQ ID NO: 2090 - DNA, 1448 bp, Rattus norvegicus
  Genbank Accession No. NM_130430
gaattcgcggcgcgtcgacctcaagaggcagaggcacatagagaaaccctatcttgaaaaacgggggagggagaaacaggggcagaatgaaaaagggaggaaggaagaaaggaaggaatgagaaagaaaagtggaaataagtcacgtataaaacgagagttaaagcctacgtcatggggttggggatttagctcagtggtagagcgcttgcctagcaagcgcaaggccctgggttcggtccccagctccggaaaaaaaaaaaaaaaagaaaaaaaaaaaagcctacgtcatcctgtctccacttagctctgccgggtcatctgaaaaccacgtggtctatttagctggagtttccggtgacctcgccccaccttcaaactcagtacttgtgcattggctgaagtattttgtcccttgggaggacccgtagctccagcctcccggtgtccgtagccgggaaacctggcgtccggcgttttaggctgaggtccgcgatgtcgagtgaggaagtccggcaccgggcagagtcctctgaggcccgtgcggccgcggtcagcgacatccaggagctgatgcgacgcaaggaggaaatcgaggcgcagatcaaggctaattacgacgtcctcgagagccaaaaaggaattggcatgaacgagcctctagtggactgcgagggctacccccgggcagatgtggatttgtatcaggtccgaacagcaaggcacaacatcatctgtctccagaatgatcacaaggcactgatgaagcaggtggaggaggccctacaccagctacatgctcgggacaaagagaagcaggctcgggacatggctgaagcccgagaagaggccatgaaccgtaggctggcctcggacagtcccgccctacccaaggcctttgccagagtgaacagtatcagccctggttccccagccagtattgcgggcctgcaagtggatgatgaaattgtggagttcggctctgtgaacacccaaaacttccagtctctgcagaacgtgggcactgtggtgcagcacagcgaggggaagcccctgaatgtcatggtgatccgcagaggggagaagcaccagctcagactgactcccacccgctgggcaggaaaaggactgctgggctgcaatattacccctctccaaagatgactgcttcctgggagctgcaggagagcttcttcagctgggcccgcgcttggcctgggggatttcctcattctctcggctccctcaagtgtaaggatctggaagagagtggcggacgcctgagcgtcgaggtggaagagacgctttggctgcctgatgtagtctctgggttgaggcattattaaaaatgtggtttgtgcttaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 2091 - DNA, 1619 bp, Rattus norvegicus
  Genbank Accession No. NM_130433
taaccttggccccggcggcgcgggggggggggggggcagggatggaaaagtaggggaaagggcaggggcgcggcctctcggggcgccgccacactattaaggctgggctagggctggtggccgagtgaagctgtgagagacccgtggaataactgagcttcgtcatggcgctgctacgaggtgtgtttatcgttgctgcgaagcgaacaccctttggagcttatgggggtcttctcaaggacttcactgccactgacttaactgaatttgctgccagggctgccctgtctgctggcaaagttccaccggaaaccatcgatagtgtcatcgtgggcaatgtcatgcagagctcttcagatgcggcgtacctggcaaggcatgtgggtttacgtgtgggagtcccgacggagactggggccctcaccctcaacagactctgtggctctggtttccagtccatcgtgagcggatgtcaggaaatctgctcgaaagacgctgaggtcgtcttatgtggaggaaccgagagcatgagccagtccccctactctgtcagaaatgtgcgcttcggaaccaaatttgggttagatctcaagctggaagatactttgtgggcaggattaacggatcaacacgtgaagctccccatggggatgactgcagagaacctggctgcaaaatacaacataagcagagaagactgcgacagatacgccctgcagtcccagcagaggtggaaagccgctaacgaggctggctactttaatgaggagatggcccccattgaggtgaagaccaagaagggcaaacagaccatgcaagtggatgagcacgcccggccccaaacgaccctggagcagctgcagaacctcccgccagtgttcaagaaagaggggacggtcacagcagggaacgcctcgggcatgtctgacggtgctggggtcgtcatcatagccagcgaagatgctgtcaaaaaacataacttcacaccactggccagagtcgtgggctactttgtgtctggatgtgaccctgctatcatggggatcggtccagtccctgccatcactggagcattgaagaaagctgggctgagccttaaggacatggatttgatagacgtgaatgaagcatttgctcctcagttcttggctgttcagaagagcttggatctcgaccccagtaaaaccaacgtgagtggaggtgccatagccctgggtcacccgctgggaggatctggatccagaatcaccgcacacctggttcacgagttaaggcgtcgaggtggaaaatacgcagtgggatcagcttgcattggaggtggccaaggcatctccctgatcatccagaacacagcctgaagggattgcaagcatcctacccaccctcacttggccaggctacggaacacaggcgacctttgagtcagccctgctgtgacagtaaatgcatttgaccaagccttgatgggttctgtctacttcatacctgcctagcgtgttagaataaaaagaccagccatcagaggcctttagagatacctactggtgtcattgtcagcagccaccactgtatgccttacatggtgaaattacaaactgaataaatgttgccttaactcc

SEQ ID NO: 2092 - DNA, 2524 bp, Rattus norvegicus
  Genbank Accession No. S45392
ggcctaggcttgccgtgcgagtcggacgtggtccgggcccaccctgctctgtactactactcggctttctcgtcaagatgcctgaggaagtgcaccatggagaggaagaggtggagaccttcgcctttcaggcagaaattgcccagctgatgtccctcatcatcaacactttttactcaaacaaagagattttcctccgggagttgatctctaatgcttctgatgccctggacaagattcggtatgagagcctgactgacccttccaagttggacagcgggaaagagctgaagattgacatcatccccaaccctcaggaagccacgctgactttggtggacacaggcattggcatgaccaaggctgacctcataaataacttgggaaccattgctaagtctggtacaaaggcgttcatggaggctctccaggctggtgcagacatctccatgattgggcagtttggtgtcggcttctactctgcctacctggtggcagagaaagtggttgtgatcacgaagcacaacgatgatgagcagtatgcctgggagtcttctgctggtggatccttcactgtccgtgcagaccacggtgagcccattggccggggtaccaaagtgatccttcacctcaaagaagaccagacagagtacttagaggagaggagggtcaaggaggtggtgaagaaacactcacagttcataggctaccccatcaccctctatctggagaaggaacgcgagaaggagatcagtgatgatgaggcagaggaagagaaaggggagaaggaggaggaagataaggaggatgaggagaagcctaagattgaggatgtgggatctgatgaggaggatgacagcggcaaagataagaaaaagaaaacaaagaagatcaaggagaagtacattgaccaggaagagctgaataagacgaagcccatctggaccagaaatcctgatgacatcactcaagaggaatatggtgaattctacaagagcctcaccaatgactgggaagaccacttggcagtcaagcacttctctgtagaagggcagttggaattcagggcattgctcttcattccccggcgagctccctttgacctctttgagaacaagaagaagaagaacaacatcaaattgtatgtccgtcgtgtgttcatcatggacagctgtgatgacctgatacctgagtacctcaacttcatccgtggtgtggttgattccgaggacctgcctctgaacatctcccgagaaatgctccagcagagcaagatcctgaaagtcatccgcaaaaacattgtgaagaagtgccttgagctcttctctgagttggctgaagacaaagagaactacaagaaattttatgaggcattctctaagaatttaaagcttggaatccatgaggattccactaaccgtcgccgcctctctgagctccttcgctaccatacctctcagtctggagatgagatgacttccctgtcagagtatgtgtctcgcatgaaggagacacagaagtccatctactatatcactggtgagagcaaagagcaggtggccaactctgccttcgtggagcgtgtgcggaaacggggctttgaggtggtatacatgactgagcccattgatgagtactgcgtacagcagctcaaggagttcgatggcaagagcctggtctccgtgaccaaggagggcctggagctaccagaggatgaggaagagaagaaaaaaatggaggagagcaaggcaaggtttgagaatctctgcaagctcatgaaggagatcttggacaagaaggttgaaaaagtgactatctccaataggcttgtgtcttccccctgctgcattgtgaccagcacctacggctggacagccaacatggaacggattatgaaggcccaggcactgcgggacaactcgacaatgggctacatgatggccaagaaacacctagagatcaaccctgaccaccccattgtggagactctgcggcagaaggctgaggcagacaaaaacgacaaagctgtcaaagacctggtggtgctgctgtttgagactgctctgtcttctctcgcttctcactttaggaggcccaaaacccactccaaccgcatctaccgcatgattaaactaggcctgggcattgatgaagatgaggtcactgcagaagagcccagtgctgctgttcccgatgagatccccccactggagggtgatgaggatgcctctcgcatggaagaagtggattaaaggctcctgggaagcccccgccctctgtatagtatccctgtggctcccccaacagccttgactggccctgacccacctgggctctctctgctcatgtctacaagaatctcttctatcctgtccttgtgccttaaggcaggaagatcccctcccacagatagcagggttgggtgttgtgtattgtgtttttttgtttgttttattttgttctgaaattaaaagtatgcaaaataaagatgatgcagttttaaaaaaaaaaaaaaaaaaaaagg

SEQ ID NO: 2093 - DNA, 2012 bp, Rattus norvegicus
  Genbank Accession No. S63519
cggtcccacttgcctctaaatgcagacagtgagtacgtcacattaagtgaccaccacttcttagggactgccagtagcagggggaatgatacggccagttgaggcatttagcagtggaactgttctataagtgggtatttattttcgacaaggtaggccacactggcctcatctgctctgagtcttcctaatatagaaagtcatggaagttgtatgtagatgcctttgtgttaaatcttgcttcagaatcagagtgggatctctgggacacataccaagctcgtttgccttcattctgtattttgtttctttgataaaataatgattttcattttttgcttaatactacattcttaagctacatagactctctccgtgatacaacaggcagtgcatgctgttactagttcttttctcctagtaaggcctacacagttatttcttgttaagaagctgtgagatgtgacctccttcctgcttagcatcacacagaaaatctgatttcaagtatctcacttattcccaccgcatcactgtcagaacagcctctcagattcacccaaagaaatacaatcatgatgactcaaatggtgtataactcaggtccagtaattctgcataggtaatcagttaaaacagtttaaacatgaaattgattcaaatattgataatgttttactaatgtgagcaacagtgttatggaaaggattcatttgactcttgtggaatgggcctgtctaatttttcttaacataatcggtaaagtattactaagaaatgctccatcctgtttctgtccaagaaaggaaagcgatacctcctgctccctgaggtggcactagggatttaaccgggaccaggaccgcctgcacgctaggcaagcactctacaaatgagatatattcctagaccaacaaatccttttgttcttctaataatttgtttaaggagtttaatcttgaactccagatgcccgcatagtcttatctgggaagatattcgtttatttctcattttgtcacccatatctacttttttcttagaggttgatgtacagatatctaaaaatatgtattcctcaatgatcttatttaggagagtgtttttactgtcatatttaaaaatagattattttcatgctgccttctgttgattttggcaaattgtataatagatcgtcttgatcattgcattttttgtcttgtaaatgtatattttgtctttgtaaattcatttacttctcaggtgtgactttatggttgactttaaacgtatgaatgaatgaggatgtaaggaaagctgtcttatttattaacgtagatgcggtaaaagaagggtatttgggtttgagcttctttttatttgagtatagaaagttatgcttttaagtaaagaaatagcaagtacagaggaaataaaaataaatagaagaaagtaaaaaggaaaaaaaccctaagaaaatgaaacaaaaaaaaagatgtaagcgaaagcaagccacatgtgatggccaatgcctgtgaccagcacttgagagactaaggcaggaagaatactacaagcttgaggcatgtgtggtttcagagtgactttgaagcccgtctgggccatagagtaagaccaggttttgttctggagaacataaacaagagtatatgataattacagggaatagtctcatggatttacataaagacaacaagagggcttaagtggagatgtgtggtgctgaagtcttgcagattggaggcagggcctgacagagcatccaccattaccaaaatccttaggatctgggagcaacaccatagctgccaagggtctgatttaaatctgttctactcactggtcagcatattggactctgctactaatataatgttaaaatagcatacctggtaaaaataaaatacacgaagtgtgttgagtgtttgagatgaaagtaaaagaaaacctaaatcattgggcaacttgggaggaaaatcattttaaataaacaaatcacatcattaccg

SEQ ID NO: 2094 - DNA, 1343 bp, Rattus norvegicus
  Genbank Accession No. S63521
gaattccaaagattcagcagttggtgaaagagttcttcaatggcaaggagccgtcccgtggcatcaacccagatgaggctgtagcatatggtgccgctgtccaggctggtgtcctctctggtgatcaagatacaggtgacctggttctgcttgatgtgtgtcctcttacacttggtattgaaactgtgggaggtgtcatgacaaaactgattccgaggaacactgtggtgcccaccaagaagtctcagatcttctccacagcttctgataatcagcccaccgtaacaatcaaggtctacgaaggtgaacgacccctgacaaaagacaatcaccttctgggtacatttgatctgactggaatccctcctgctccccgtggggtaccccagattgaagtcacctttgagatagatgtgaatggtattcttcgagtgacagctgaagacaaagggacaggaaacaaaaacaaaatcaccatcaccaatgaccaaaaccgcctgacccctgaagaaattgaaaggatggtcaatgacgccgagaagtttgctgaggaagacaaaaagctcaaagagcgcattgacacgaggaatgaattggaaagctatgcttactctcttaagaaccagatcggagataaagagaagctgggaggtaagctgtctcctgaagataaagagaccatggagaaagctgtagaggaaaagatcgaatggctggaaagccaccaggatgcagacattgaagactttaaagctaaaaagaaggaactagaagaaattgttcagccaattatcagcaaactctatggaagtggaggccctcccccaactggtgaagaggatacatcagaaaaagatgagttgtaggtgcactgatctgctagagctgtaatattgtaaatactggactcaggaactttcgttgggagaaaattgagagaacttaagtctcgaatgtaattggaatcttcacctcagagtggagttgaaaatgctatagcccaagtggctgtttactgcttttcattagcagttgctcacgtgtcttggggtcagggagaggaggaattggctattttaaaattggggaaaagctgggtcagggtgtgtgttcaccttggatatgttctatttaacggttgggtcatgcacatctggtgtaggaacttttttctaccataagtgacaccaataaatgtttgttatttacactggtctagtttttgtgaaaagcttgtaattatatccatcttttattttagataactaaaatttaagactggaaaaaaaaaaaaaaaaaaaaaaaaaaaaaaaaaaaaaaaaaaaaaaaaaaaaaaaaaaaaa

SEQ ID NO: 2095 - DNA, 351 bp, Rattus norvegicus
  Genbank Accession No. S68135
tcttccaactcaaccaaccactcgattaatctttccttgcctgagaccagttgaaagcactggagtgcagggaggagagggaagggccaggctgggctgccaggttcaggtctcctgtgcactgagggccagacaaacaccatgagaaggacctcggaggctgagaacttactgctgaagacacggacactcctgccctgctgtgtatagatggaagatatttatatattttttggttgtctattaaatacagacactaagttatagtatatatctggacaaacccacttgtaaatacaccaacaaactcctgtaactttacctaagcagatataaatggctggtttttag

SEQ ID NO: 2096 - DNA, 195 bp, Rattus norvegicus
  Genbank Accession No. S69316
actctcactatgaatcctgtgtggagagggaatgtgacattttaaagttatttcttttgagagacttgttttggatgctcccccaagcctccctctcccctgcactgtaaaatgttgggattatgggtcacaggaagaagtggtttttttagttgaatttttttttttaacattcctcctgaatgtaaatttgta

SEQ ID NO: 2097 - DNA, 742 bp, Rattus norvegicus
  Genbank Accession No. S74257
tttttttgtgccactgcttcctctctagccgtgagactccagctacttcactatgcgacttctcaccctctccggtttgttcttcatgctgttcctctgtctctgcgttctctcctcagaagggagaaagcgtcctgccaagttcccgaaactcaggcctgctgtcatctatctcctagatccaaaccaataactggaaaggaaaccacacaagaccctgcagaccatgcagaaagctagaatccaattcatggggtggtgcctggggctctcccacagatatagggcctcccgaagctggcctccaccgagatgaaacgttgatgtccagttatggagacaaccttctggcccctaccaaccttcatggccagaaagctgtgacaccagaatgtttcacttcagacagctgaaggattacagaattccaagccctcgttccaaaggtgcaaccaaccttcagagtcactatgatccagggtcagcccacaagtcttcatggctcctgcagagtaaaagtccaagattccatccctgggagctacagattcagagacttccaagctgactggcgaacagagtagcaagacttccttgtgatcagatgagattacagcatcttaggaaccctcggacacccccaaacccatagcatttaatcaacgggatatgaaccaactcctgtaacttcctaatgtaatcaccaggagaacaccaaaaataataaatcataaatcaatgt

SEQ ID NO: 2098 - DNA, 2090 bp, Rattus norvegicus
  Genbank Accession No. S75280
ccgtctgtggggtgtttgttcttgccctcgtagccctctgtccagccgccatgataagcgccagcagagccgcggccgcgcgtctcgtgggcaccacagcgtcccggagtcccgccgccgcccgtcaccaggatggctggaatggccttagtcatgaggtttttagatttgtttcaagaagggattatgcgtcagaagcaatcaagggtgcagttgttggaattgatttgggtactactaactcctgtgtggctgttatggagggcaaacaagccaaggtcctggagaactccgaaggtgccagaactaccccttctgtggttgcctttacaccagatggggagcgacttgttggtatgccagcaaaacgacaagctgtcaccaacccaaacaatactttctatgctacaaagcgtcttattggacgacgatatgatgaccctgaagtacagaaagacactaagaatgttccctttaaaattgtccgtgcctccaatggtgatgcctgggtggaggctcatggaaaactctattctccgagtcagattggagcgtttgtgttgatgaagatgaaagagactgcagaaaattacttgggccatacagcaaaaaatgctgtgatcacagtccctgcttatttcaatgactcacagcgacaggccactaaggatgctggccagatatctgggctaaatgtgctccgagtgatcaacgagcctacagctgcagctctggcttacggtctggacaaatccgaagacaaagtcattgctgtatatgatttaggtggaggaacctttgacatttctatcctggaaattcagaaaggagtgtttgaggtgaaatccaccaatggggacactttcttaggaggtgaagactttgaccaagctttgttacggcacattgtcaaggagttcaagagggagacaggggttgatttgaccaaagacaacatggcacttcagagggttcgggaagctgctgagaaggctaaatgtgagctctcctcatctgtacagactgacatcaacttgccataccttacaatggatgcttctggaccaaagcatttgaatatgaagttgactcgagctcagtttgaaggcattgtcacagatctaatcaagagaactattgctccgtgtcagaaagctatgcaggatcgagaagtcagcaagagtgacataggagaagtgatcctggttggtggcatgacgaggatgcccaaggttcagcagactgtgcaagatctttttggcagagccccaagtaaagctgttaatcctgatgaggctgtagccattggagctgccattcaaggaggtgtgttggctggtgatgttacagatgtgctactcttggatgtcactcccctctctctaggtattgagacacttggaggtgtctttaccaagcttattaataggaacaccactattccaaccaaaaagagccaggtattttctactgctgctgatggacaaactcaagtagagattaaagtgtgtcagggggaaagagagatggccggagacaacaaacttctaggacagttcactttgattggaattcccccagcccctcgtggagtgcctcagattgaagttacatttgacattgatgccaatgggattgtgcacgtttctgccaaagataaagggacaggacgtgagcaacagattgtaatccagtcttctggtggattaagcaaagatgatattgaaaacatggttaaaaatgcagagaagtacgctgaagaagaccggaggaagaaggaacgtgttgaagcagttaatatggctgaaggaattgttcatgacacagaaaccaagatggaagaattcaaggaccagttgcctgctgacgagtgcaacaagctaaaggaagagatttccaaaatgagagaactccttgctcgaaaggacagtgaaacaggagaaaacattaggcaggcggcatcttcccttcagcaggcatcattgaaactctttgaaatggcatataaaaagatggcatctgaacgggaaggttctggaagttctagcactggggaacagaaggaagatcaaaaggaagagaagcagtag

SEQ ID NO: 2099 - DNA, 1747 bp, Rattus norvegicus
  Genbank Accession No. S76054
gcagctgctccgctcgctctcgaacctccgtcttcagctcactgccttcactccagacttcaccatgtccgtcagggtgactcagaaatcctacaagatgtccacctccggtccccgggccttcagcagccgctcgttcacgagtggacccggtgcccgcatcagctcttccagcttttcccgggtgggcagcagcagcagcagcttccgcggaagcctgggcggctttggcggggctggtgtcgggggcatcacggcggtcacggtgaaccagagcctgctgaaccccttgaagctggaggtggaccccaacatccaggctgtgcgcactcaggagaaagagcagatcaagaccctgaacaacaagttcgcctctttcattgacaaggtacgcttcctggagcagcagaacaagatgctggagaccaaatggagcttgctgcaacagcagaagacatccaggagcaacatggacaacatgtttgagagttacatcaacaacctccgtcggcagctggaagccctgggccaggagaagctgaagctggaggtggagcttggcaacatgcagggcctggtggaggacttcaagaataagtatgaggatgagatcaacaagcgtacagagatggagaatgagtttgtcctcatcaagaaggatgtggatgaagcctacatgaacaaggtggagcttgagtcccgcctggaaggactgaccgacgagatcaacttcctccggcagatccatgaagaggagatccgtgagctgcagtctcagatctcagacacgtctgtggtgctgtccatggacaacagccgctccctggacatggacagcatcattgctgaagttcgtgcccagtatgaggagatcgccaaccgcagccgagctgaggccgaaaccatgtaccagattaagtatgaggaattgcagaccctggctgggaagcacggggatgatctacgtcgctcgaagacggagatctctgagatgaaccgtaacatcagccgcctgcaggcggagattgacgccctcaaaggccagagggcaaccctggaggcggccattgctgatgcagagcagcgtggggaactggccgtgaaggatgccaatgccaagctggaggatctgaagaatgccctgcagaaggccaagcaggacatggcccggcagctgcgcgagtaccaggagctgatgaacgtgaagctggcgcttgacatcgagatcgccacctaccgcaagctgctggagggcgaggagagcaggctggagtctgggatgcagaacatgagcatccacacgaagaccaccagtggctacgcaggaggactgagttcatcctacgggggactcactagccccggcttcagctatggaatgagctctttccagcccggcttcggttctgttgggggatccagcacttatagccgcaccaaggctgtggtcgtgaagaagattgaaacccgagatgggaaactggtgtctgagtcttgtgacatcatgtccaagtgaatggccactgaagtcattgccagcctgaggtcctgcagctgctcaggggtcaaggggagacagctgtatggcagagtgcagggaactagggaccagccagagtaccagccctaaacctctggccaaccttgggaggaatttctatctgggatatgccaatgcccaactcaattgtattttccaaaataaagcctcagtggctgtaaaaaaaaaaaaaaaaaaaaaaaaaaa

SEQ ID NO: 2100 - DNA, 1950 bp, Rattus norvegicus
  Genbank Accession No. S76742
ggcagggtggggctcaccgctccccacttaccggcctcgcccctctcgtgcgcgttaatgagattagcaattaaaaggcgggcgagccgcggccagagaccaggccctgacgagaagcgagcgcgggacatggagaaggcacggcctcaatggggcaatccgctgcagttcgttttcgcctgtatctcctacgccgtgggtttgggcaatgtgtggcgcttcccctacctgtgccagatgtacggcggagggagtttcctggtcccctacctcatcatgctcattgtggaggggatgccactcttgtacctggagctggctgtggggcagcgcatgcggcagggcagcattggtgcctggaggaccatcagcccctaccttagtggtgtcggtgttgccagtgtggtggtctccttcttcctctccatgtactacaatgtcatcaatgcctggggcttctggtacctcttccactccttccaggatcccctgccgtggtctgtctgcccactgaatagtaaccgcacaggctatgatgaggagtgtgagaaggcttcgtcgacacagtacttctggtacaggaaaacactcaacatctcaccgtccatccaggagaatggaggagtgcagtgggagccagccctgtgcctcaccctggcctggctgatggtatatctgtgcatcctgagaggcaccgaatctactggcaaggtggtctacttcaccgcattgatgccttactgtgttcttattatctacttggtccgtggcctcacactccatggagccaccaatggcctgatgtacatgttcacacctaagattgagcagctagccaaccccaaggcctggatcaatgcagccacgcagatcttcttctcactgggcttgggttttggcagcctgatcgcttttgccagctacaatgaaccctccaacgactgccagaagcatgctgtcattgtgtctgtcatcaacagctccacctccatatttgccagcattgtcaccttctccatctatggcttcaaggccaccttcaactatgaaaactgcttaaacaaggtgattctgctgctgaccaattcttttgaccttgaagatggctttctgacagccagcaacctggaggaggtgaaggactacctggcatctacttacccaaacaagtacagtgaagtgttcccacacattagaaactgcagcttggaatcagagctgaacacggctgtccaaggcacaggcctggccttcatcgtctacgctgaggccattaaaaacatggaagtgtcccagctctggtcagtgctctacttcttcatgctgctgatgctgggaatggggagcatgcttggaaatacagcggccatcctcacccctctgactgacagcaaggtcatctccagctacctgcccaaggaggccatttcaggtctggtgtgcctcattaactgtgctgttggcatggtgttcaccatggaggctgggaactactggtttgacatattcaatgactatgcagccacgctgtctctgctgctcattgtgctggtggagactatagctgtgtgctacgtgtatgggctgaggagatttgaaagtgatcttcgggccatgactggccggcccctcaactggtactggaaggccatgtgggcttttgtgagcccactgctcatcatcggcctctttatcttctacctgagtgactacatcctcacgggaacgctgcagtaccaagcctgggatgctactcaggggcagctggtgaccaaggattaccctccacatgcactagctgtcatcggtttgctggtggcttcatctactatgtgcatccccctggtggccctggggactttcatcaggaatcgcctcaagaggggaggctcttccccagtggcctaagaatggacctcccaaagaccgaagtcagccactctgtttcac

SEQ ID NO: 2101 - DNA, 951 bp, Rattus norvegicus
  Genbank Accession No. S76779
aagcttatgaaggctctgtgggccctgctgttggtcccattgctgacaggatgcctggccgagggagagctggaggtgacagatcagctcccagggcaaagcgaccaaccctgggagcaggccctgaaccgcttctgggattacctgcgctgggtgcagacgctttctgaccaggtccaggaagagctgcagagctcccaagtcacacaggaactgacggtactgatggaggacactatgacggaagtaaaggcatacaaaaaggagctggaggaacagctgggcccagtggcggaggagacacgggccaggctggctaaagaggtgcaggcgacacaggcccgtctgggagctgacatggaggatctacgcaaccgactcgggcagtaccgcaacgaggtaaacaccatgctgggccagagcacagatgagctgcggtcgcgcctctccacacacctgcgcaagatgcgcaagcgcctgatgcgggatgcggatgatctgcagaagcgcctggcggtgtacaaggccggggcacaggagggcgccgagcgcggtgtgagtgctatccgtgagcgcctggggccactggtggagcagggtcgtcagcgcacagccaacctaggcgctggcgccgcccagcccctgcgcgatcgcgcccaggctttgagtgaccgcatccgagggcggctggaggaagtgggcaaccaggcccgagaccgcctagaggaggtgcgtgagcagatggaggaggtgcgctccaagatggaggagcagacccagcagatacgcctgcaggccgagatcttccaggcccgcatcaagggctggttcgagccgctagtggaagacatgcagcgccagtgggcaaacctaatggagaagatacaggcctctgtggctaccaactccattgcctccaccacagtgccctggagaaatcaatgaggatcc

SEQ ID NO: 2102 - DNA, 613 bp, Rattus norvegicus
  Genbank Accession No. S77858
gcagcagccaagatgtgtgacttcaccgaggaccagaccgcagaattcaaggaggctttccagctgtttgaccgaacaggcgatggcaagatcctgtacagccagtgtggggatgtgatgcgggccctgggccagaaccctaccaacgccgaggtgctcaaggtcctggggaaccccaagagcgatgagatgaatgtgaaggtgctggactttgagcacttcctgcccatgctgcagactgtggccaagaacaaggaccaaggaacctacgaggattatgttgaaggccttcgtgtgtttgacaaagaagggaatggcactgtcatgggtgctgaaatccgtcatgtcctagtcacactgggggagaagatgacagaggaagaagtcgagatgctagtggcggggcatgaggacagcaacggttgcattaactatgaagagcttctccggatggtgctgaatggctgaggacatttacgtgtctcgagcctgctccttgcccagtgtgagattcctgtgtggccccagaggctccctaatcacagcaccttgcctgtctggtttcttttggatgatgtttgccttcaccaaataaaacttgctctctgtgctc

SEQ ID NO: 2103 - DNA, 1008 bp, Rattus norvegicus
  Genbank Accession No. S77900
  misc_feature (1)..(999): n = a or c or g or t
acacccaaagccaagatgtccagcaagagagccaaggccaagaccaccaagaagaggccccagagcgctacgtccaatgtcttcgctatgtttgaccagtcccagatccaggagtttaaggaggccttcaacatgattgatcagaaccgtgatggcttcattgacaaggaggacctacatgacatgctggcctccctggggaagaaccccacggatgagnacctggagggtatgatgaacgaggccccgggacctatcaacttcaccatgttcctcactatgtttggggagaagctgaacggcacagaccccgaggacgtgatccgcaatgcctttgcctgctttgatgaggaagcctcagggttcatccacgaggaccacctgcgggagctgctcaccaccatgggcgaccgattcacggatgaggaggtggacgagatgtaccgtgagcgcattgataagaagggcaacttcaactatgtggagttcactcgcatcctcaagcacggcgccaaggacaaagacgactaggctcttcttagctgtcccaatgcctacaccccatcccagtcacctcctcaacaacacatacactctaccctccccatgaggagttagggtcccggctcccagggcaggaaatgagccattaagacgcacagggtgaggctaggggttccaccacggacccaggcactagaggaagggccacagtggggaggtgagccaagggtggggccagctagcaccaaagtgaaggaagccactgaagatggccaccctcagccatgccctcccattccagggctaccctgaggaagaaaacacccatgttctggtgttggacactaattcccagcatccccacaaaggtacacacccattcaccatgtcccttcagaggatgacagtctgcacttcacctatggagttgtcccagcacacccagaatgcatagagggacgctgcctgagggacaaattctctaatacaaggctgagcacaaaa

SEQ ID NO: 2104 - DNA, 3144 bp, Rattus norvegicus
  Genbank Accession No. S81497
ccgtgactgaagaagccattgccaagggtatcgcaggattgttgctgtcacaggtgctgtagactgaggttgaaggactaccccggagacggctgcagtcgttcggttcctgtctcttccgtgtaggatttgatttctcctaaacttggtttaagacttttaaagaaggccctaatttatcgaggcctgtttgtgaagtaaaattcggctggctactctcaacggaagaaagatgcaactgctaggccgggtgatctgtttcgtcgttgggatcctgctttctgggggcccaacggggaccatatcagctgtggaccctgaagcaaacatgaatgtgactgagataatcatgcactggggatatccagagcactcagtacagacaggagatggctacattctgggtgttcaccgaatcccgcatgggcggaagaaccagtttgataaaggtcccaaaccagttgtgtatcttcagtggcgacatggcttcctggcagattctagtaactgggtcacaaacattgacaacaacagcctgggcttcatcctggcagatgctggctttgatgtgtggatgggaaacagcagaggaaacacctggtctcggaagcacaagactctgtcagtttctcaggatgaatactgggccttcagttttgatgagatggcaaaatatgacctccctgcttcaattaactacattttgaataaaactggccaagaacagctgtataatgtgggccactctcaaggctgcaccataggttttatagcattttcacagatgcctgaactggcaaagaaggttaaaatgttttttgccctggctcctgtgttgtctctcaattttgcttcgggcccgatggtcaaattgggacggttgccggatctgcttcttgaggacttgtttgggcagaagcaatttcttcctcagagtgcaatggtgaaatggctaagcactcacatttgcacgcacgtcatcatgaaggagctttgcgccaacatcttctttctgatatgtggcttcaatgagaagaatttaaacatgtctagagtggatgtgtatacaacacactgtcctgcgggaacctctgtgcaaaacatggtacactggacccaggttgttaaataccataagcttcaagcttttgactggggaagcagtgacaagaattattttcattacaatcagagttatccacccttgtacagcataaaagacatgcaactacccactgctttatggagcgggggcaaggactggctggcagacaccagtgacatcaatatcttactgactgaaatccccacgttagtgtaccacaagaacattcccgagtgggaccatctggattttatctggggtttggatgccccctggaggctgtataatgaagtagtcagtctaatgaagaaataccagtgagtgccaagacttgagatgcttccccttcactaggggaaaaaaggacagatgtttgcttaattcctgcaaaatactgtgttttcctggtctagatcatttgtattttttatgtgcaagaaaacgatgatgttgaagacatacatgggtctggtcagtaagaagcacgctggctgtcttctgcttcattctgactgacaagccagagtcacaaccagtgatgcctttgaagtttttagaaagtatgggtgttacgtgaaagaagccattgcaacctcttgtttactttttacggtcgttttcggtgtctgcatgctgtgcatatacatgcctatgtgtgtgccctgtgctggccagagcctccttgtgtggaggtaatggctcacatcagggtatcttccctcagacactggtctctcgacgaaccagtcagtagcttgctattccagttagactggctgaccagggagcctccagaatctgtccgtctctaccttccctcaccaggtctacggagggtgatgtcccagccagcattttacactggttctagggacaggaactcaggttctcatgcttgatagcaagccctttcttcaccaaaccattgcctcaaaccctctgtgatcgaaaagctgctcaattacctttatgttcccacccaatgcaagtgaacgagcacaagacatttcaagctgttgtttgtgagctaaaaatcaatctgccagtgacttgaacatgctagggagaaactcctggccctgagcttgacaaacctgcagtccaggttctccagagattgagacagggaggctgctgttacatttagggttcatttggagagtgagactttgtctctacaaaaccaaagacaaaggagaagaagaaaaaaaaaaccctaaagtactcagttctcatctgttagcctcagagggcttagagagttcctgtgtttacctatccgaacaacattttcatgtctttatgcagtagctacctagtgaaatccagtgttatcccagcttctccaggcgtaaacattctctcttcaatctcatcagacctcagtagcaagcatttagtgaatatttagatttttcaggccaagccaagacaaaaatgaatagaataaaagaaaaaagagcccagactcttgaaagcggtttgcactgatttaaaaataaaaaaaaagaatcttgaagaatgacatgataaactgtgttggttccgcatgtgtagtcggatcccttttctgtggagaacgttctgtggagggacaaaccactaatttgccccaagtgaatgtggctgtagtgacagcgacagtgcctctgatcctgagaagcagggctggctgccggtgacaagcatcccagttcctttccccagagatgaagaggatgttttcagacagagctcggctcagggaatttcgcttggagaatcagtggtttatgtgcacaatgttttagtgagcctgctctgcgcctgatatggggaagccctcgactgttcaccgggctcgtgggcgacggctgccgtcagctggacagtggataagttttctgagtagtcaccacagattcagggatatcgctttgtgtcgactcctaaggaaggcaggacgatatgacttggtaacattgtaaaggttcacatttaaacttttcaataaatctcagcctcacaggcctgaacatcaaaaaaaaaaaaaaaaaaaa

SEQ ID NO: 2105 - DNA, 185 bp, Rattus norvegicus
  Genbank Accession No. S82579
aataaaatatgtgtcatccattctttttgagtaaggtgatatttattgattctctgttgacaaaacctaaatatttctctacttgtacagagtgttaatcttctcactttcttctacagtagtttctatcatatgttttattaatagcatcagaaaatcatgggctggtgggatggttcttccaa

SEQ ID NO: 2106 - DNA, 648 bp, Rattus norvegicus
  Genbank Accession No. U02506
aatcccaatattaagaggttaaaaaataggaccagaagtttaaagtaatccttggctacctagtgagtgtaaggccagcctggaatcaataagagttggtttcaaagaagcaggaggagaaggaggaacaggaacaggaggaggagcagggggaggagaaaaaggaggaggaggaggaggaggaagaggaggaggaggaggaggaggaggaggaggaggaggaggaggaggaggaggagaagaagaagaagaagaagaagaagaagaagaagaagaagaagaagaagaagaagaagaagaagaagaagaagaagaagaagaagaagaagaagaagaagaagaagaagaaattagaagaagaaaagaagaaggacaaatggctcttttctggtctcaccttttcccttcctgtcactcatgtggacctcagataagagcacagatactctcgacctcttacatttggagagttttgagcagacaggaagaagacggagcctgggagcagctgttctccaatagtcaaattaagactgttcctctctgagctctgtacttcaaccagcacctttaggcagaagccatcaaatcagaaatgtctgttaataattaaagtctatgattgccaccaaaaaaaaaaaaaaaaaa

SEQ ID NO: 2107 - DNA, 1089 bp, Rattus norvegicus
  Genbank Accession No. U03390
ggcacgaggggtcgcggtggcagccgtgcggtgcttggctccctaagctatccggtgccatccttgtcgctgcggcgactcgcaacatctgacgccatgaccgagcaaatgacccttcgtgggaccctcaagggccataatggatgggttacacagatcgccaccactccgcagttcccggacatgatcctgtcggcgtctcgagacaagaccatcatcatgtggaagctgaccagggatgagaccaactacggcataccacaacgtgctcttcgaggtcactcccactttgttagcgatgttgtcatctcctctgatggccagtttgccctctcaggctcctgggatggaaccctacgcctctgggatctcacaacgggcactaccacgagacgatttgtcggccacaccaaggatgtgctgagcgtggctttctcctctgacaaccggcagattgtctctgggtcccgagacaagaccattaagttatggaatactctgggtgtctgcaagtacactgtccaggatgagagtcattcagaatgggtgtcttgtgtccgcttctccccgaacagcagcaaccctatcatcgtctcctgcggatgggacaagctggtcaaggtgtggaatctggctaactgcaagctaaagaccaaccacattggccacactggctatctgaacacagtgactgtctctccagatggatccctctgtgcttctggaggcaaggatggccaggctatgctgtgggatctcaatgaaggcaagcacctttacacattagatggtggagacatcatcaatgccttgtgcttcagccccaaccgctactggctctgtgctgccactggccccagtatcaagatctgggacttggagggcaagatcatggtagatgaactgaagcaagaagttatcagcaccagcagcaaggcagagccaccccagtgtacctctttggcttggtctgctgatggccagactctgtttgctggctataccgacaacttggtgcgtgtatggcaggtgactattggtacccgctaaaagtttatgacagactcttagaaataaactggctttctg

SEQ ID NO: 2108 - DNA, 1318 bp, Rattus norvegicus
  Genbank Accession No. U04808
gtgggactgggtgagtggctggcacttcctgcagaagtccccgtccccagctgctcaggacctcaccatgcctacctccttcccggaattggatctagagaactttgagtatgatgactctgctgaggcctgttatttgggtgacatcgtggcctttgggaccatcttcctatctattttctactcccttgtcttcacgttcggtctggtggggaatctgttggtggtcctcgccctcaccaacagccggaagtccaagagcatcactgacatctacctcctgaacctggccttgagcgacctgctctttgtggccactttgcccttctggactcactacctcatcagccatgagggcctccacaacgccatgtgcaagctcacgactgctttcttcttcattggcttctttgggggcatattcttcatcaccgtcatcagcatcgaccggtacctcgccatcgtcctggccgccaactccatgaacaaccggacagtgcaacacggcgtcaccatcagtctgggcgtctgggcggcggccatcttagtggcgtcgccccagttcatgttcacaaagagaaaggacaacgaatgtttgggtgattaccccgaggtcctgcaggaaatctggcccgtgctccgcaactcggaggtcaacatcctgggcttcgtcctgcccttgcttatcatgagcttttgctacttccgcatcgtccggacgctgttttcctgcaagaaccggaagaaggccagagccattaggctcatcctcttggtggttgttgtcttcttcctcttctggacgccttacaacatcgtgattttcctggagactctcaaattctacaacttcttccctagttgtggcatgaagagggacctgaggtgggcccttagtgtgacggagacagtggcgtttagccactgctgcctcaacccctttatctacgctttcgctggggaaaagttcagaaggtacctgagacacctgtacaacaagtgcctggccgtcctgtgcggtcgtcctgtccacgccggcttctcaacagagtcccagaggagcaggcaggacagcattctgagcagcttgactcactacacaagcgagggagagggatctctcctgctctgaagggtctccccgaccccgactctactaagaacccagagttcctgcatctgactctgtgtaatgaaaacagattcacacacacacacacacacacacacacacacacacacacacacaccccgctcctcctgcattttatgtgcaagaaatacggaccaggtacctgcaaatcaatccacagtgttt

SEQ ID NO: 2109 - DNA, 1612 bp, Rattus norvegicus
  Genbank Accession No. U05675
aggcaaagggcaactgcttggaatttcagaaaatctgaaaccatgaggcatctatggctgctgctcctgtctgtttccttagttcaaactcaagctgcaactactgactccgataaagtggacctctcgattgcccgtggtcatcgacctgttgacaggagaaaggaagagcctcctagcctaagacctgcccctcctcctatcagcggaggtggctatcgagcccgtccagccaaagttgatgcaggtcagaagaaagtggaacgaaaaccccctgatgcaggaggctgtgttcacggtgacggagacatgggagtgctatgtgctacagggtgtgagttgcgtcaaactttgctaaaccacgaaaggccaatcaaaaacagtattgctgagttaaatagcaacataaactctgtttatgagacctcttcggtcacctttcagtacctgactctgctgaaagacatgtggaaaaagaagcaggcacaagttaaagataatgaaaatgtcataaatgagtattcctccattttggaagaccagaaattatatattgatgagactgtgaacgataatatcccccttaatcttcgtgtgctccgctcaatcctggaggacctgagaagcaaaatgcaaaaattggagtctgacatctcagctcagacggaatactgccacactccatgcaccgtcaactgcaacatcccggtggtgtctgggaaagagtgtgaagagatcattcggaagggaggtgagacatccgaaatgtatctcattcagcctgacacctccagcaaaccatacagagtgtactgcgacatgaagaccgaaaacggaggatggacggtcatacagaaccgtcaggatggcagcgtcgactttggcaggaaatgggacccatacaaaaaaggatttggaaatattgcaaccaacgaagatacgaagaagtactgtggcttgccaggcgaatattggcttggcaatgataagattagccagctcaccaggataggacccacagaactcctaatcgaaatggaggactggaaaggagacaaggtgaaggcacactatggaggcttcacggtgcagaccgaggccaacaagtaccaagtgtcagtgaacaagtacaaagggactgctggcaacgccctcatggaaggggcctctcagctggtgggggagaacagaaccatgaccatccacaacggcatgttcttcagcacctacgacagggacaacgatggctgggtaactacagatccaagaaagcagtgctcaaaagaagatggcggcggctggtggtataacagatgccatgcagccaatccgaatggcagatactactggggtggcctttacagctgggacatgtccaagcacggcacagatgatggtgtggtgtggatgaactggaagggatcgtggtactccatgagaaggatgtctatgaagatcaggcccgtcttcccacagcaatagtcccccaagcatagactttcagccttctatgtctgacattttttacattatgttattggaattttctttgatacattatatccactaatgctcaaaacaatggctgagtgtgtctttttttttttttttt

SEQ ID NO: 2110 - DNA, 1589 bp, Rattus norvegicus
  Genbank Accession No. U06230
aattggcttgaaaccagttgtagggggttcgaatcagaatctctcgatcactcaaattggctcctgattgcacttcgtgaagggaagattgaagttcagtttaagaatgagttttcaacccaaatcacaactggaggcaatgttattaacaatggtatatggaatatggtgtctgtggaagaattagacgacagtgttagcattaaaatagctaaggaggccgtgatgaatattaataaacttgggagtctttttaaacctaccgatggatttctggacaccaaaatatactttgcaggattacctcggaaggtggaaagtgcactcattaagccgattaatcctcgtctggatggatgtatacgaggctggaacttgatgaaacaaggagctttgggtgcaaaggaaatagttgaaggaaaacaaaataaacattgcttcctcactgtggagaagggctcctactaccctggttcaggaattgctcagttcagcatagactacaataatgtaactaatgcagaggattggcaaataaatgtgaccttgaatattcgcccgttcactggcactggggtcatgcttgctttagtttctggggacacagtgccctttgccttgtccttggtggattctggctctggaacttctcaggacattctggtatttgttgaaaattcagtagcagctcacttagaagccataactctgtgctcggaacagccatcccagctgaaatgtaacattaacagaaatggactggaactgtggaccccagttagaaaagacgtcatttactctaaagatctccaaaggcaactcgccatcttggacaaaacaatgaaaggaaccgtggccacttacctgggtggcgttccagatatttccttcagtgccacaccagtgaatgctttttacagcggctgcatggaagtgaacatcaacggggtacagttggatctggatgaagccatttccaaacataatgacattagagctcactcctgtccgtcagtgaggaaaatccagaagaacttctaaagtctgtttcctgggcttctaatctctcttttcatattgtaattatgctcttgttcatgtttccatcaccaaatggcaggattacatgtgttatatgcatgtttaaatatgatgtggtactttgtccttcagatttttgttatataagtcgcatttttgaaaagtcttgtactcactgctgtctagaaattaaataacaaaacacatgaaacatttaaatttcaatttatttcctataaatcttccagtgcgtcacaggcaacataatctgctccattgtctttggagagcgctttgactacagagaccgccagttcctgcgcttgctcgacctgttgtataggaccttttccctcataagctcattctccagccagatgtttgaggtctactctgacttcctgaagtactttcctggtgtccacagagaaatctacaaaaacctgaaggaagtcctcgactacattgatcatagtgtggagaaccacagggccactttggaccccaatgctccccgagactttatcgatactttccttctggaattc

SEQ ID NO: 2111 - DNA, 279 bp, Rattus norvegicus
  Genbank Accession No. U06434
atgaagctctgcgtgtctgccttctctctcctcctgcttgtggccgccttctgcgattcagtgctgtcagcaccaataggctctgaccctcccacttcctgctgcttctcttacacctcccggaagattcatcggaactttgtgatggattactatgagaccagcagcctttgctcccagccagctgtggtatttctgaccaaaaaaggcaggcaaatctgtgccgaccccagcgagccctgggtcaatgagtatgtgaatgacttggagttgaactga

SEQ ID NO: 2112 - DNA, 2226 bp, Rattus norvegicus
  Genbank Accession No. U07201
aagaagcttggcgactgtaaggcgagaggaagcctccagcgggtcttgtcgctgagctacctcagctccacctcctctggccctggcccctagtgcgcagactgcctgcagccctcctgtagcatgtgtggcatctgggccctcttcggcagcgatgactgcctttccgtgcagtgtctgagtgcgatgaagattgcgcacaggggcccagatgcattccgttttgagaacgtcaatggatacaccaactgctgttttggcttccaccggctggcggtggttgaccccctgtttggaatgcagccaataagagtgaggaaatatccttatctgtggctgtgttacaacggtgaaatctacaaccacaaggcgctacaacaacgtttcgaatttgagtatcagaccaatgtggacggtgagataattctccatctctatgacaaaggcggcatcgagaaaaccatctgtatgttggatggggtgtttgcatttatcttactggacactgccaataagaaagtattcctgggcagagatacctatggtgtcaggcctttgtttaaagccttgacagaagatggatttctggctgtgtgttcagaagccaaaggccttgtctccttgaaacactccaccacccccttcctaaaagtggagccctttcttcctggacactatgaagttttggatttaaaaccaaatggcaaagtcgcgtctgtggaaatggtcaaataccatcactgtacggatgaaccactgcatgccatctatgacagtgtggagaaactcttcccaggctttgagatagagaccgtgaaaaacaatctgcgtatcctttttaacaacgctatcaagaaacgcttgatgactgaccggaggattggctgccttttatcaggaggcctggactccagcttggttgctgcctccctgctgaagcaactcaaggaggcccaagtgccctatgctctccagacatttgctatcggcatggaagacagccctgatctactggctgccagaaaggtggcaaattatattggaagtgagcatcatgaagtcctttttaactctgaagaaggcattcagtccctggacgaagtcatatttcccttggaaacttatgatattacgacagttcgagcatctgtaggtatgtatttaatttccaagtatattcggaagaacacagacagcgtggtgatcttctccggagaggggtcagatgagcttacacagggctatatatatttccacaaggcgccttctcctgagaaggcggaggaggagagtgagaggctcctgaaggaactctacctgtttgatgtcctccgtgccgaccgcactactgctgctcacggtctcgaactgagagtcccgtttctggatcatcggttttcttcctattacctgtctctgccaccagaaatgagaattccaaaagatggcatagaaaaacatctcctgagagagacttttgaggactccaacctgctacccaaagagattctctggcgacccaaggaagccttcagtgatgggatcacctcagtcaagaactcctggttcaagattttacaggacttcgttgaatatcaggttgatgatgcgatgatgtctgaggcctcccagaaatttcccttcaatactccccaaactaaagaaggctattactaccgtcagatctttgaacaccattaccccggccgggctgattggctgacccattattggatgcccaagtggatcaatgccaccgacccttctgcccgcactctgacccattacaagtcaactgccaaagcttagacgctctctacactcttgtgtaaaagtcaatgtttcttcctcctgctctgaaggtagagagacattgaaacaatcagagagaatgaaagtcaaccatcagctgctcaggcttatttaggcatggaaagaaataaaagtatcacatctaaaatgcctcctggttgtaggtaccagtgcggccttgtagctagagactgagtggctcttgctgtattgccactgtcgggatgacagtgagctatgctaaggggcatcttagttctgccttcattcctaacagctggctagtcagattgctatgtgagtcctttgtgggaactggtgacaattctgctttgtaggccaaggattcagtttctttctctttctttctttctttctttctttctttctttctttctttctttcttggaattc

SEQ ID NO: 2113 - DNA, 3287 bp, Rattus norvegicus
  Genbank Accession No. U09229
atcacgacccggatccgagcatctgagactggttctgatgaagccatcaagtccatcctagaacaagccaagagggaactccaagtgcagaaaaccgctgagccagtccaggcgtcttccacagccagcagtgggaactccgacgatgccatccgctccatcctacagcaggcccgccgggaaatggaggcccagcaggctgcccttgaccccgccttaaagccagcaccactgtcccagcccgacctcaccatcctcaaccccaagctcctgtctgcctcacccatgtctactgtgtccacttacccccctcttgccatctccctgaagaaaacccctgcagcacctgaggccagtacctcagccttgcccagtgccccagccctcaaaaaagaggctcaggatgcacccacactggacccaccaggatcagctgatgctaccccgggggtactgaggccggtgaagaatgagctagtccgtggcagcacctggaaggatccttggtggaaccctgtacagcctgaaagaagaaatcttaccacttccgaagagaccaaggccgatgaaacaaatgcaagtgggaaagaaaagacaggcagcagccaacctcgggctgagcgcagccagcttcagggaccctcggcgacagcagagtactggaaagagtggcccaacgctgagtccccatactcccagagctcagagctgagcctcactggagccagccgcagtgagacaccccagaatagcccactgccctcttccccaattgtgcccatggcaaagccggccaagccttccgtgcccccgctgactcctgagcagtatgaggtctacatgtatcaggaagtggacaccatcgagctcactcggcaggtcaaagagaagttggccaaaaatggcatttgccagaggatctttggggagaaggtactgggcctgtcccagggcagcgtcagcgacatgctctcaaggccaaaaccatggagcaaactgacccagaaaggccgagaacccttcatccggatgcagctctggctgaatggagagctgggccaaggtgttctgcctgtgcaagggcaacaacaaggaccagtccttcactcagtgacgtctctgcaggaccccctccagcagggctgtgtgagttcagaaagcactccaaagacctctgccagctgcagccctgcccctgagtccccaatgagttccagcgaatctgtgaagagtctcactgagctggtccaacagccctgtcccaccattgagaccagtaaagaaggcaaaccaccagaacccagtgacccacccacctcagactcccaacccacaacaccgctgcctctctctggacactcagccctcagcatccaagaattagtagccatgtctcctgagctggacacctatggcataaccaagagggtcaaagaggtgctgacggacaacaacctcggtcagcgcttatttggagagaccattctggggctcacccagggttctgtctccgacctccttgcccgcccaaagccctggcataagcttagtctgaaaggacgggagccctttgtccgcatgcagctatggctcaacgaccccaacaatgtggagaagctgatggatatgaagcggatggagaagaaagcctacatgaagaggcgacacagctctgtcagtgacagtcagccttgtgaacccccctctgttggtatcgactatagccagggtgccagcccccagccacaacaccagctgaagaaacctcgagtggtcctggctccagaggagaaggaagcactgaagcgagcatatcagcagaagccatacccatcaccaaaaaccatcgaggagcttgccacacaactcaacctgaagactagcaccgtcatcaactggttccataattacaggtctcggatccgcagagaactgttcattgaggagattcaagccggaagccagggccaggccggtgccagcgactcaccttcagctcgaagtagccgggctgcacccagctctgaaggcgacagttgtgacggcgtggaagccgctgacaccgaggagccaggtggcaacatagtggccaccaagtctcagggagggccggcagaggtgaccgcagccccggcagaccgggaagaagcgacgcagccggccgagaaggcgaaggcacagccactatcctcggggaccccaggacaagacgacggtgaagacgcaggccggtctaggccacctcctgagggtcttgctgacgccccagcgcccgtgccaaacctcgccgcacccgcggccggagaggacgccgctacctcagccactgccccagccatggccactgaggcccctggggcggccagggccggccctgccgagaggagttctgcgttgccaagcaccagcgcgcctgccaacgcgcctgcgcgaaggcctagctctctgcagagcctctttggtctgcctgaggcagcgggcgcccgggacaacccggtgcggaagaagaaggccgcgaacttgaacagcatcatccaccgcctggagaaggctgccagccgggaggagcccattgaatgggagttctgagggcgccgggcctctgggcctgaccagcagggcctcgccgggctagccaggcctacttgcgcctagcaggtcccccaggcctagtcagcactggctagtggtgggctggggcaggcgggtgcgtggagggctgtgctgacccgaggcctggacgtgttgcgcacttaccgccctgcgggccacagggcaaaatcgccataggccaaggtgcatatagaaaacaaaggagcattaagcccaatctatgttgtgttttcaaggaagaaaacggaaatgtgtagtcaagcttttttgtaccctgaagtgttttttttttaattgccctaagtgatttccacaggttctggaataactctttacagcttttgccttgcgccctcctctttcgtgtgggctttaaaaaaaaaaaatcaaacccacatattaaaagggggctttttatctgccatctaatggcttcagagcgataatacactattatcttcttaaaccaggaagggggggattttttcagaaaaattaaaaaagaaagtttttgtagctgttcagttgccactaagagattgcacagtcaaaccgactctaaacacactagtttggattcctaaatattttcaagaaaagaatcttctcgtttgaaactttgaattaaaataaaacacatttactccacatattttttaacaaaaaaaaaaaaa

SEQ ID NO: 2114 - DNA, 1133 bp, Rattus norvegicus
  Genbank Accession No. U17035
cctcggctgagctgcattccaatcccagctacatccggagcccagctacattcgagcccagccacatcccgagccaaccttccagaagcaccatgaacccaagtgctgctgtcgttctctgcctcgtgctgctgagtctgagtgggactcaagggatccctctcgcaagaacggtgcgctgcacctgcatcgacttccatgaacagacgctgagacccagggccataggaaaacttgaaatcattcctgcaagtctatcctgtccgcatgttgagatcattgccacaatgaagaagaacaatgagaagaggtgtctgaatccggaatctgaggccatcaagagcttattgaaagcggtgagccaaagaaggtcaaaaagagctccgtaactagagagaagccactcgccacagtgctgagaccgatggacagcagagagacggtctctccacctccctttacccagtgtgcggctagtcctaactgtccctgtttctcctgaccatggtcccatcagctggtactcccactacagcgtgatggacaaggcctggtcctgagacaaaagtaactccagcagcaaggcttcccaattctctaagagctggtccgaatcttccctcaggcagctatgacggctctcctagctctgttccgtaagctatgtgcaggtactaatctcttcagcatgtgccatgccccagcctgctccacacaccctccttctccctagctctaagctcatcagttctgagttcacctgagctcctttatttcaaatgcagtccaggtgagatggcaaatcaagtttgtcagaacaaacttaccaccaccttcccaagggaatttcataactcagaatactcacaggaacctagacatgcatgtttaaatattatttaatgaccgactgtacaaagtggaactcctagatgtattttttgtacgattttcattgtatatgtaagaacttgtgtggttaagtatgtatcaatgggtagttaaagtttacataggcaaatgctttgaatgctacatattacaagatgtgttggatggttttcaaaataaaatgtactgtattgaatgtagtatgagacaaaaaagtaataaagtaataataactgacatga

SEQ ID NO: 2115 - DNA, 1812 bp, Rattus norvegicus
  Genbank Accession No. U17565
ctcagagatgaggagcagacagctgagagcattaagaaccaaatgacggtgaaggaatgggaaaaggtgtttgaaatgagtcaggaccaaaacctgtaccacaatctctgcactagcctcttccctacgatccacggcaatgatgaagtaaaacgtggcgtcttgctgatgctgttcggtggcgttcccaagacaacaggggaaggaacctctcttcgtggggatataaatgtttgcattgttggggatccaagtacagctaagagccagtttctcaagcatgtggatgagttcagtcccagagctgtgtataccagtggcaaggcctccagtgcttccggcttgacagcagctgtggtgagagatgaggaatctcacgagtttgtcatcgaggctggagcgttgatgctggctgataacggtgtctgttgcattgatgagtttgataagatggacatgcgggaccaagttgctattcacgaagctatggagcagcagaccatatctatcactaaagccggagtgaaggcaactctgaatgccaggacatccattttagctgcagcaaaccctgtcagcggacactacgacaggtcaaaatctctgaaacagaacatcaatctgtcagcgcccatcatgtcccgctttgacctcttcttcattttggtggatgagtgcaatgaggtgacagattatgctattgccaggcgcatagtagacttgcattcgaggatcgaagaatcgatagaccgggtttattcccttgatgatataagaaggtatcttctcttcgcccgacagtttaagcccaagatttccaaagagtcagaggacttcattgtggagcagtacaaacgcctccgccagagggatggctctgggatcaccaagtcgtcgtggagaatcactgtgagacagcttgagagcatgatccgactctcagaatcgatggcccgcatgcactgctgtgatgaggtccagcctaaacatgtgaaggaagcttttcgattactgaataaatcgatcatccgtgtagaaacgcctgacgtcaatctagatcaagaggaagagatccagatggagacggatgagggaccaggaggcatcaatggtcatgctgacagccctgcccctgtgaacgggttcaatggctctggtgaagatgccagtcaggagaccgttcccaagccctcccttaggttggcctttgctgaatactgccgaatctctaacctcatcgtgcttcacctcaggaaaatggaagaagaggaggatgagtcagccctaaagaggagcgagctggtcaactggtacctgaaggaaatcgagtcggaaatcgactctgaagaagagctcataaataagaagaggatcatagagaaggttgttcatcgtctcacacactacgatcacgttctgattgagctcacccaggctggactgaaaggctccagtgaaggaagcgagagctatgaggaagatccttacctggtagtcaacccgaactacttgcttgaagattgagatatagaaggtgacttacggccaggaaccgggggtggcctaccttagccgggacctgggcatgcactgagaccgtttctggagcgatgcttgggggacagttgagaagagacagctgaacagtgagtaatgccgtgatttcatgctggacatgcgtgggtactttgtgcttttcctacacatgaaataaaaagtatttcagaaaacatgattgggatccaacttcaacaggacaagacaaagtgcccacgcatgtgccagcattaaatccacggccatgaactcagc

SEQ ID NO: 2116 - DNA, 612 bp, Rattus norvegicus
  Genbank Accession No. U20110
agatctaccatggttcaaccagatgtggactgcctagagccctgctctggaggggaccaaccgtgggggcaactgctgctctccctggagtatgattttggaagccaggaggtaaggcccgctcagcaggtccagaggctccatggttgatggaggaggagatggatgaagagccaggtagaggggaacaagggaaaaggacccccctcccaggctgagtcaacccattggtcctcagattagagtgggcctgaggcaggctaaaaatctgaaggctgagggcacagcagacccctacgcccgtgtcagtgtttccacccaggccgggagaagacatgagacaaaagtgcaccgtgggacactctgtcccatgtttgaagagacatgctgcttcctggtaagtctagcctgaagagatagagtgggctggagccaggacagcagaacccagctcatagccctgcctacaggtcccaccagcagagctgcccaaagccactctgaaggtgcagctattggacttcaagcggttttcagaacatgagccactgggggagctccagctacccctgggcactgtggaccttcgacatgtcctggagagctggtacc

SEQ ID NO: 2117 - DNA, 3628 bp, Rattus norvegicus
  Genbank Accession No. U20796
cgctccaactgtgatgccaacggcaaccccaagaacacggatgtctctagcattgacggtgttctcaagagcgaccgcacagactgtcctgtgaaaacaggcaaacctggtgcccctggcatgaccaagagtcacagcggaatgacaaaatttagtggcatggttctgctatgtaaagtctgtggggatgtggcctcaggattccactatggagttcatgcttgtgaaggctgtaagggcttcttcaggaggagcattcagcagaacatccagtacaagaagtgcctgaagaacgagaattgctccatcatgaggatgaacaggaaccgctgccagcagtgccgcttcaagaagtgtctgtccgtgggaatgtcgcgggacgctgttcgatttgggcggattcccaagcgtgaaaaacagagaatgctaattgagatgcaaagtgcaatgaagaccatgatgagcacccagttcggtggccacctgcagagtgacaccttagcagagccgcatgagcagtcagtaccaccggctcaggagcagctgcggcccaagccccagctggagcaagaaaacatcaaaagcacccctcctccttctgattttgcaaaggaggaagtgattggcatggtgaccagagcccacaaggatacctttctgtataatcaggaacatcgagaaaactcatctgagagcatgccaccccatagaggagaacggattcccaggaatgtggagcaatataatttaaatcatgaccatcgtggcggtgggcttcacagccacttcccctgtagtgagagccagcagcatctcagtggacagtacaaagggaggaacatgatgcactacccaaacgggcataccgtttgtatttcgaatggacactgtgtgaacttctccagtgcttaccctcaaagagtctgtgataggattccagtaggtggatgttctcagactgagagcaggaatagctacctgtgcagcactggagggaggatgcatctggtttgtcctatgagcaagtctccatatgtggatcctcagaaatctggacatgaaatctgggaagaattttcaatgagttttaccccagcagtaaaagaggtggtagaatttgcaaaacgtattcctggcttccgagatctgtctcagcatgatcaggtcaacctgttaaaagctgggacttttgaggttttaatggtgcgatttgcttcgttatttgatgcaaaggagcggactgtcaccttcctgagtggtaagaagtacagtgtggatgacctgcactccatgggagcaggcgatctgctcagctctatgtttgagttcagcgagaagctgaatggcctccagctcagcgacgaggaaatgagcttgttcacagctgttgttctggtgtctgcagatcgatctggaattgaaaatgtcaactcagtggaggctctgcaggaaacactcatccgtgcactaaggaccttaataatgaaaaaccatccaaatgaggcctccatttttacaaaattacttctaaagttgccagatcttcgatctttaaacaacatgcactctgaggaactcttggcctttaaagttcatccttaaggcctttgaacatgaactgatgctaatgtacattttatgctgagatgtttatttatatgtgtataccatattgtgaaaatagaaaaggacttagcgccaggtcctggactgtctgtagtcagtcaccagtagctgttcagatgagaactcattgtcttgttagacattggcccaccctccctgtagaccaaccagctgtgttgcacttagactggagaagttacactgaattataatcacactgaatgttagactttttcatctgccaaagccaaaataccatgttgatctccccggggtataaatctagcgcacattggagatatagggaggacttaaacattacccctgtgtgacaggattcgggtgccccacaagattgatatgtggtaaaggagactgagagacaagaggtgtgctctggcactgacaaagaacatggtcctgggagtcccctgggttgtgggaaatgataattgatagtgtccccaatgtcctgcctcacagagatactgaaaaaatgtccataaagcgtctttacctcttgggagataggcactatgtaaataaggtgaagtttttattataattgctcataataatattcttgtcttatctctaagcatttctgggaaactttgagagtccacaccaatttattcagggttccagctcaagtggggttccctactgataaacacatattccaggtttatggacacgtcagatagtatgtgtacatagtgtgtatgtgaatataattatatataaaatcttacttcacaatattttaaactgtgaagaactttatcatacaataaacttaaacaagaggtgtcaaggacccaaattaggtgcattttacctgttgctgctgatgtataaccattgctttatgatgtttagatggtagaatactgaagttaattctcatatttttgtttaagcaacatttaatgtaaaagtgtaatgagcagtcaaatccaggtcagaaaaaacatggattttagaatacatctttgatacaatctgcagttgaaggtaatagatgtttcagtgtttcagatttctaccttgcgctattaatagaggtggtgttgctgcttcttacctgctgcaggtggatggcagatttggattctgtgtggaggatgttttgtttggggaaaacctttgtgacctattggcatgtctgtgcccaagtccacttttctttctttcccttaaataacactacagggattttgtcaatttagatttaatataatttgaaaaacctttaataagtgacctacctacaggcttagagatcgtggtaggagaggtagccaaagttaaagattcgtgaacaacacccctgttcccccctgagctgtaattcattgtattttgggggcaaaattattttctgtgtaatgctagattatgtgaaattgtaaagacattaagaacatgctttactatttaaagcatgcctattacttttatgacatgtaagcagaatgccttattttgtagttctaacttgttgctacaggatttgaacttctgtggtacagttaagagagcttgaaaaagataaacccctgttgtcgaagaagaaagctgatggtgcgtctgttatgcagtagggaccataactgctgtttacattcagtgggtatggctttcgtgggatacacagctagggtttgtgaattctttacatgatagcattatcattttatatttttttcaaggataaaccaatgcatagttttcttctatgggggatagagagctttgtgaagtaatactgaaaacctcaaaggttatgttgattcttcatttttgcctttttcataagtgtctttataacatgtatctttaaagcagtttgcgtctttggaaatatgtaaccagagctgttagtgttgcttgtgatgcttgagttagggtcagtatatacatgtacacacctagatagaagcatgtagatttgtattttgtctcgtaaaattttatttcaataaattcttcctgaagt

SEQ ID NO: 2118 - DNA, 975 bp, Rattus norvegicus
  Genbank Accession No. U21718
ctgatcaacaacttcagggtgatgggaaaataattgataggagaccagaaaggcgaccacctcgtgaaagaagatttgaaaagccacttgaagaaaaaggtgaaggaggtgaattttcagttgatagaccgatcatcgaacggcctatccgaggccgaggtggtcttggaaggggtcgaggtggccgtggccgtggaatgggccgaggtgatggatttgattctcgtggcaagcgtgaatttgataggcatagtggaagtgatagatctggcctgaagcatgaggacaaacgtggaggtagcggatctcacaactggggaactgtcaaagatgaattaacagagtcacccaaatacattcagaaacaaatatcttataattgcagtgatttggagcaatcaaatgtgactagggaaacacctgaaggtgaagagcacccagtggcagacactgaaaataaggagaacgaagttgaagaggttaaggaagagggtccaaaagagatgactttggatgagtggaaagctattcaaaataaagaccgagcaaaagtagatttaatatccgaaaaccaaatgaaggtgctgatggacaatggaaaaagggatttgttctgcataaatcaaaagttgaagaggctcatgcggaagattcagttatggaccatcatttccggaagccagaaaatgatataacgtctcaactggagatcaatttggggagacctaggccgcccaggacgttgtgggagagagaggacgtcgtggacgtggccgtggtggtcgtcctaatcgtggcagcaggactgataagtcaagtgctttctgctcctgatgtagatggccccagaggcattcccccgctctggcctaactggatgccataatacaacactggttcctttgtggaccctcctgttcaaagcttttgcatgcttacttttgcatgcttaaggatcccaaacaactaagaatt

SEQ ID NO: 2119 - DNA, 428 bp, Rattus norvegicus
  Genbank Accession No. U21719
caccctaacctaaaccttttgaattttgaattaatgggtaccctatagaaaaaatgacctgcggaaaaccaaacagtgaagggaaagaaggaaagaattccaattgacacaatttaaataaaatatggcttttcaaataaaggaagagaagtttcttttgggcacacaatctaaacaatatttatgtataattcagctcttatttggcttaaatgggcttagtgggaaatgttatcatttttactattttctacagagaaaatattttccagtttatcaagtaactctggactttggaattacctgtttttatgttccagctgtctatatagttgtttctctgaaattgtacataaaatgtttttacattaaaatgaattactgtataaagtactgcattatgcataataaagatactaatgctttat

SEQ ID NO: 2120 - DNA, 3531 bp, Rattus norvegicus
  Genbank Accession No. U25746
cacgctctgatggcggtcactgctggagctttggccatttcgtagggccggtcctcgctcggtactgtgaggacttggtgcctccctcctttgtcctcttcaccggtctgcgcatcgtccccaagggcgcaggccttccgctggctggcagcatgggcagggagtctcgccattaccgaaaacggtcagcatctcgaggtcgctctggaagtcggtctaggagtcgctcaccctctgacaaaagaagcaaacgtggagatgacaggcgttccaggagtagagacagagacagaaggagagagaggtctcggagcagggacaaaaggagatctcggtcacgggacaggaaacgcctgagacgttccagaagtagagagcgtgacagaagccgagagcgaagaagatctcgaagccgggatagaaggcgctcaaggagtcggagccggggcaggcggtcccggtcttccagtcctggcagcaaaagcaagaaggctgagaacaggtctaggtccaaagagaaagcagaaggtggggacagctccaaggagaagaagaaagacaaggacgacaaggaggacgagaaagagaaggatgctgggaattttgaccagaataagctggaagaagaaatgagaaaacgaaaagaaagggttgaaaaatggcgagaagagcagcgtaaaaaggcgatggagaacataggggagctgaagaaggagatcgaggagatgaagcaggggaagaagtggagcctggaagatgacgacgatgatgaagatgaccctgccgaggctgagaaggaagggaatgaaatggaggacgaggagctggacccattagatgcctacatggaggaagtgaaagaagaggtaaaaaagtttaacatgaggagcgtgaaaggcggcgcaggaaatgagaagaagtccggaccgactgtcacgaaagtggttactgtggtaacaaccaagaaagcagtagtagatgccgacaagaagaagggagagctgatggagaatgaccaggacgccatggagtactcctcggaggaggaagaggttgaccttcagacggccctcacaggctaccagacaaaacagagaaagcttctagagccagtggatcatgggaaaattgagtatgagccattcagaaaaaacttttacgttgaagttccagaattagcgaaaatgtctcaagaagaggtgaatgtgtttcggttggaaatggagggcattacagttaaaggaaaaggttgccccaagccaattaaatcatgggtccagtgtggaatttccatgaagatactgaattccctcaaaaagcatggctatgaaaagcccacaccaatccaaactcaagcaattcctgctataatgtctggacgagatttgattggcattgccaagacaggaagtggaaaaaccattgcttttcttttgcccatgtttagacacatcatggatcagaggtcattggaagaaggagagggaccaatcgctgtcatcatgactccaactcgagaactggctttacaaatcactaaagaatgtaagaagttttcgaagaccttgggactgagagtggtctgtgtgtatggagggacaggaatcagcgagcagattgctgagctgaagagaggcgctgagatcattgtttgcacacctggccggatgatcgacatgctggcagctaacagtggtcgggtcacaaatcttcgaagagtgacatatgttgttttagatgaagcagacagaatgtttgacatgggttttgaaccacaggtcatgcgcattgtggacaatgtccgtcctgaccgacagacagttatgttctcagctactttcccaagagctatggaagcgttggcccgcaggatcttgagcaagcccattgaagttcaggttggaggccggagtgtggtttgctcagatgtggaacaacaagtgattgtgattgaagaagagaagaaattcttgaaattgctggagcttttaggccattatcaggagtcaggatctgtcattatatttgtggataagcaggaacacgctgatggtcttctgaaggacttgatgagagcttcctacccttgcatgtctcttcacggaggtattgatcagtatgacagggacagtatcataaatgactttaagaatggaacctgcaaacttctcgtagccacgtctgttgccgcccgtggtctagatgtgaaacatctcattcttgtagtaaattacagctgccccaatcattacgaagattacgtgcacagggctgggcggactggaagagcaggcaacaagggttatgcctacaccttcatcacagaagaccaagctcgatatgctggggacatcattaaagctcttgaactgtcggggacggcggtgcctcctgacctagagaaactatggagtgacttcaaagatcagcagaaagctgaaggaaaaataattaaaaagagcagcggcttctctggcaaggggttcaagtttgatgagacagagcaggctttagccaatgagaggaaaaagctacaaaaagctgcccttggcctgcaggattctgatgacgaggacgccgcagttgatattgacgagcagattgaaagcatgtttaattccaagaagagagtgaaagacatggctgctcccggcacatccagtgcgcctgctccgactgcgggcaatgctgagaagctagagattgccaagaggttggcgcttagaatcaacgctcagaagaacctgggcatcgagtctcaggtagatgtgatgcagcaggccacaaatgccatcctcagaggtggccctcttctggctcccaccgtgtctgcaaaaaccatcgcagagcagcttgccgagaagatcaatgccaagctcaattacgtgcctttggagaaacaggaagaagagagacaggagggtgggcagagcgaatctttcaagagatacgaggaagaattagaaattaatgacttcccacagacggcgaggtggaaagttacctctaaggaagccttgcagaggatcagtgagtactcggaagccgccatcacaatcagagggacctacttcccgcctggcaaagagcccaaggaaggagagcggaagatctacttggcgattgaaagtgccaacgagctggctgtgcagaaagcaaaggcagagatcaccaggctcataaaagaggagctgatccgactgcaaaattcataccaacccaccaacaaaggacgatacaaagtattataaacaccggagccactttgtacccgtgctatctgtgacgtttacagtgtattgtaaagtaagacttttaaaattctgtcttgcttattttttaagtacaagaaaccagtgtttgttcaagaggtcatctgtaagtactaccctatacccatccaaactccatttaaatcagagctgttttcagagtgtgatgttcttcgatgtaaaccttagataccaacactttaaatatctggagacattgggattttgtactgaatgcagtaataaagtgtgtcaggca

SEQ ID NO: 2121 - DNA, 1947 bp, Rattus norvegicus
  Genbank Accession No. U27518
ggcacgagaggactttgatcttcaggatgcctcagaagtggatttctgctctgctcctactgcagataagtttctgcttcagatctgggaactgtgggaaagtgttggtgtggccattggaatacagtcactggatgaatttaaagataatactggatgaacttgtacagaggggacatgaagtcactgttctcagaccttcatcttccgtctctcttgatcccaaaaaagcatctggtcttgtatatgaaacatctcctacaacttccaataatgatgaagtagaaaagtctttttacccagtgggtgatatgtggacatacgatgtgccaaaatatacatgtttgagatactacccatctttgaacaaaatgttcgggcaattttctgatttgtggttacagctttgtagagaagttgtttcaaacaaggaacttatagcaaaactaaaggaatcccagtttgatgtggttctttcagatgctgttggtccctgtggtgagctgatagctgagatactgcagttaccatttgtgtacagtcttcgctttgccaccgcccctggaatagaaaagtacagtgcaggacaacccttccctccctcttatgtacctattattttgtcaggatttagtggtcaaatgacattcatggagagagtggaaaatatgctatgtttactttattttgattcctggttcgagtcatttcctgctaaggattgggatccatttttcagcgaaattttaggaagacccactacaatggttgacacaatgaagaaagcagaaatatggctcattcggtcctactgggacttggagtttccccgcccatccttgccaaacattgagtttgttggaggacttcactgccaacctgccaaaccattacctaaggaaatggaagactttgcacagagctcaggagaacatggtgtgtgggtgttttctctggggtcgatgatcaggaacataacacaagaaagggctaacacaattgcatcagccctggcacaaattccacaaaaggttttttggagatttgagggcaagaaaccagacaccttaggacccaatactcgggtgttcaagtggataccccagaatgaccttcttggtcatccaaaaactaaggcttttgtaactcatggtggagccaatggcatctatgagtcaatccattatgggatcccccccatggttggcatccctttatttgcagaacaacgtgataacgttgctcacatggtagccaaaggagcagctgtttctatagattttcatacaatgtccagttcagatttgctcaacgcactgaaggcagtcatcaataacccctcctataaaaagaaagtgatgtggttgtcagccattcaccatgaccagcctctgaagcctctggacagagcagtcttctggattgagtttgtcatgcgtcacaaaggggccaagcatctgagaccacttgcacataaccttgccctggtatcagtacactctctggatgtgattggattcctgcttgcctgtgtgctggccattgttttacttgctgtaaaatgctgtctgtttctttaccgattttttgtaaaggtggcaaagaataaaagggactagggttctttaagaaggaaggctgtgatctgtggtcgtgatgggcatgactactccctttattgctggaactatatatcagatgctccttgttttagaagacattgagctaattgatttatctatagatgtcacactataggttaagaaagtaaccgttttaaatctttattttctcaaatccaccgttttcatattgattctcgatgtgatagtgctgaggataatgataatccctgaaacaccaacttgcttatgggcaaagatataggaagcctaaactttttactgtgaattttcagatatttataaaataaaattgaataaaatt

SEQ ID NO: 2122 - DNA, 1700 bp, Rattus norvegicus
  Genbank Accession No. U28504
agtggatggagaccaagtccatcaattagaagataagtctcaaatggagaaccggtgcctccccaagaaagttccaggtttctgttcctttcggtatggactggctatccttttgcacttctgtaacattgtcatcatggctcagcgagtgtgcctgaacctcacaatggtagccatggtgaataaaacagagccaccccatttatctaacaagtctgtagcagagatgctggataatgtaaagaaccctgtgcattcctggagtcttgatattcaagggcttgttctcagttctgtcttcttgggtatggttgtgattcaagttcctgttgggtacctatctggagcatacccaatggagaaaataattgggtcttcattgttcctcagctctgtgctgtccctgctcatcccaccagctgcacaagtcggagcagctttggtcattgtatgccgagtactccaaggaatagcccagggagcagtgtcaacaggccagcatggaatatgggtcaaatgggcacctcccttggaacgaggcagacttacctctatgactctatcagggtttgtaatgggaccatttattgccctgcttgtgagcggcttcatctgtgatcttctgggttggcccatggttttctacatctttggtattgttgggtgtgttctgagtcttttctggttcatccttctctttgatgaccccaacaaccacccatatatgagcagcagtgagaaggattacatcacatcctctctcatgcaacaggtgcactcaggcagacaatctctgccaatcaaagctatgcttaagtctcttccactctgggccattatcctcaatagctttgctttcatatggtcgaacaatcttctggttacatacacgccaacatttattagcaccacgcttcatgttaatgttagagagaatgggctgctgtccagcctcccctatctgcttgcctacatctgtggtatcgtagcaggtcagatgtcagacttcctcctgtcaaggaagattttcagcgtagttgctgtccggaaactcttcaccacactagggattttctgtcctgtgatttttgtcgtgtgcctgctctacctgagctacaacttctacagcaccgtcattttccttacacttgccaactcgacacttagcttttccttctgtggacaacttatcaatgccttggatattgctcccagatattatggatttctaaaggcagtcacagctttaattggaatatttgggggcctaatttcttcaactcttgctgggttgatccttaatcaggatccggaatatgcttggcataaaaacttcttcttgatggcaggcattaacgtgacatgcctggctttctaccttctgtttgcaaaaggagatattcaggactgggctaaagaaacaaaaaccacacggctgtgaagttagtagaagagtgagcacctgagaaacatgaggtcagcatccatattgaaaggaagaggattctgtgtgggactgcagtcatgggagtcatgaacacctgaagaccggtagcctgaagcttttaagggagtcattgcctcccactttagtctgagtgattcttttgcactgtgtattgtgtgtaacaagttatacttctgactttaaagaggaatctgtctgtcttcctatgatccaataaacaaacgtattcggg

SEQ ID NO: 2123 - DNA, 2620 bp, Rattus norvegicus
  Genbank Accession No. U30831
gggcggccgtgccacctcgccggaccggcgagggcaaaggggctgtggcgacgcatgcccgggccggagtgagtgagcgcgggcgaagatggcgtacatccagttggaaccactgaacgagggctttctttccagaatctctgatgtgctgctgtgtggatggacttgtcaacactgctgtcagaggtgctatgagtccagctgctgccagtctagtgaagatgaagtggagatcttgggacctttccctgcccagactcctccatggctgatggccagccggagcaatgacaaggatggtgactctgtgcacacagccagcgatgttcctttgaccccaaggaccaactcccctgatgggagacgctcatcctcagacacatccaagtccacatacagcctgactcggagaatctccagtctggattcccggcgccccagctccccactcattgacatcaaacctattgagttcggtgttctcagtgccaagaaggagcccatccagccatctgtgctgcgccgaacctacacccctgatgactacttcaggaagtttgagccccgactttactcccttgactcgaatcttgatgacgtagactctctgaccgatgaggagataatgtccaagtaccagctgggcatgctgcacttcagcacccagtatgacctgctgcacaaccacctcaccgtgagggtgatcgaggcccgggacctgccgcctccaatctcccatgatggctcccgccaggacatggcccattccaacccctacgtcaagatctgcctcctgcctgaccagaagaactccaagcagacgggagtcaaacgcaagacccagaagcctgtgtttgaggaacgctacaccttcgagatccccttcctagaagcccagaggaggaccctgctgctcactgtggtggattttgacaaattctcccgccactgtgtgattgggaaagtagcggtgcctttgtgtgaggtggacttggtgaagggcggccactggtggaaagctctgatccccagctctcagaatgaagtggagctgggagagctgctgctttctctaaactatctcccaagtgctggcagactgaatgtggacatcattcgagccaagcaactcctgcagacagatgtgagccagggttcagacccatttgtgaaaatccagctggtacacggactcaagcttgtgaaaactaagaagacatcattcttacgaggcacaatcgatcctttctacaatgaatccttcagcttcaaagttccccaggaagaactagaaaacgccagcctagtattcacagtgttcggtcacaacatgaaaagcagcaacgacttcatcgggaggatcgtcatcggccagtattcctccggcccctcggaatccaaccactggcggcgaatgctcaacacacaccgcactgctgtggaacagtggcatagcctgaggtcccgggctgagtgtgaccgagtgtctccggcctcgctggaggtgacctgatcgccataaggaaggcaaccttcatttgttaaaaaaagaggaaaaaaatgtgtcacataaatattcagcccacacctacgtatactttcacacatatgcacgtgcatacacaacgccctctctgtatcgagagccagctgacagttgatcatgaaacagcccacctcattgagggaagcttgtcgaagtttccagacactccattcatgtataatcacaagcctggtagactctgctgtgggacttactagcattgcctactctatccacactatgaccaaatgtacttcgaccctcaggccagagaaaggaggccttcctaggaagagccagagtcagtttaccaagagttcagctgttatttggggggcttgattccccacttcaaaaccatatcttccaggaaagttctgaacaggccactgttaactggggtcccttctccaacggtgtaagtactctttattttctccttagcaaatatgataaatagattagaccctttggagagaccaaagggtagcaaaagacagtaagttcgtgtcaggagcacactctcagctgctctgtccttgtgttaacttattgctgggactccttgtgggtgtgtgtgtgttattgtgagtgtgcctcacgggtaagtacatgtgtgcctgttcatcccattagacagcaaggcagtagccaggacctccatccatgaagctctcttgcctctgccttttatccaatgcaagtttaccccatatcctctcacacatcagagacccaacctgaggtagtgatagttcacatatgtccataatagggttttgatagagcagaggtaacatgtctgactgaattgtggtggttataaccattggggtttggcatgggacgagaatggtactacatccctccaccatgacctctccccaaaaccagactccagtgagccttctgtgtttctgtgtgcaccacagtcatgtctcatgtgctaaggctttagtgtagttagaatagagttccctcacaggatgcttctgtatctttctccacagcgtattgtcctctgtgatggggagttatctgttgttgaaataaaagattatttatttgtgaccc

SEQ ID NO: 2124 - DNA, 573 bp, Rattus norvegicus
  Genbank Accession No. U31598
gtgcttgaagcttctccccaggcgtggtgggatgagtcgcagaaccacacattccgtcacactctgttctgccaggatgggtttcccaacatagggctctccgagacctacgacgaggacgcactcttctccttcgacttctcccagaacaccagagtgccccggctgcctgagtttgctgagtgggctcaggaacagggagatgcctctgccattgcgtttgacaaaggcttctgcgacatgttgatgcagaatgtgagcccgcggcttgaaggtcaaatcccagtgtccagaggtttgccttcggctgaggtgttcaccctgaagcccctggagtttggcaagcccaacacgctggtctgtttcatcagcaacctctttccaccgactttgacggtgacctggcagcatcatttcgtccccgtggagggagccagccccacatccgtttcagccatcgatgggctcaccttccaggccttctcttatttaaacttcacaccggaacccttcgacctttactcctgcactgtgacgcacgagattgaccgctacacggcgattgcctattgg

SEQ ID NO: 2125 - DNA, 1998 bp, Rattus norvegicus
  Genbank Accession No. U33500
ggtgctgctgctgcatgtctgactgagaagggagccgagcatctgaggagcaagacatcagaaggctggagtcccttccctgactaggccagagctaaaaggacaaggctcagggctagcctctgcctatctagttcttttctccctgaagcttacaccatcctgtgggagccgatgcccgtctcattttgactcagagtctgtccctctgcttgtcttctacaaaccatgtggctgtacctgctggcactggtgggcctgtggaacctcctgcgcttgttcagggagaggaaggtggtaagccatctccaagacaaatatgtcttcatcacgggctgtgactcaggctttgggaacctgctggccagacagctggacaggagaggcatgagggtgctggctgcatgtctgactgagaagggagccgagcagctgaggagcaagacatcggacaggctggagacagtgatccttgatgtcaccaagacagagagtattgtggcagccactcagtgggtgaaggagcgagttgggaacacaggactctggggcctggtcaacaatgctggcatctccggccacctgggtcccaatgagtggatgaacaaacagaacattgcaagtgtgctggatgtgaacctgttgggcatgatcgaggtgactctgagcacggtgcccttagtgaggaaggcgaggggccgtgtggtcaacgttgccagcatcgcaggccgactgtctttttgtggtggtggttactgcatctccaagtatggtgtagaggccttctcagactccctcaggagagagctctcctattttggggtcaaggtggctattgtagagcctggcttcttcaggactgatgtgaccaatggtgtcacattatcatcaaacttccagatgctgtgggaccagaccagctcagaagtcagggaagtctatggcgagaactacctggcatcttatctgaaaatgctaaatggattggaccagaggtgcaacaaagatctgtctctggtgactgactgcatggagcacgccctgacttcctgtcaccctcgcacccggtactcagctggttgggatgccaagttcttctacctccccatgagctatctgcccacctttcttgtggatgcccttttctactggacttctccaaagcctgagaaagctctctgaagtctttacctatgtacataactgaggagatgttggtacagtgttagggaggggatcctgaggaggaggtcggagtgctgaggagggagggaggtcattcctctggggtttagtccacactcttcattttgctaattttcctgtgctactactcaaggctgactcgactgacccaagaaatagccaaagaattctgcgaagaagttcaaatacaaaagtgctggcagttgcctagcctctgggcaccatgacctaccatggcgatccacacaaatggggagtttgagaccagcttgtaccaaacactgccctgggtccccctgtgcaggaagtgcacatgccctggctagtttgtaccctatgcagcatagaagtgtccctgctctgaagtcacctgtgaccctggtgtcaggtttgagaagaatcactaataattctaacactcatgcttgaaggccaggtcgcagcctgggtgggagagtcggttacttgtggtgagaatatagtagaggatagagacattaattttttttaaatttactttgaagtcatggctcttcttttcttttttggagtcttttcctttttagagcatagcatgaggtgacctcttgttccctgtgatttaaacaatggcattgctggttggtgaggtttggattgcaggggtaaggggaatgtcctgagaagggtgtgcataggccagcaggaatttccttgcccgtctcagcccttctagccactgaggtgggaataactgctgtccattcaaaacttaacaacaacccctaaggcataagagcatgcatgcaggcc

SEQ ID NO: 2126 - DNA, 1482 bp, Rattus norvegicus
  Genbank Accession No. U34897
ggtaccgtgtgccagtccacacttactaagtcacatgctctgaagtgggaagcttccctgagaaaaggagcctcagcctcaggccagggagtgttcccatgcagatgacactgggtcagttggctgcttaccttctgctccctccaagattagacccttaggtctttctctcacgatctgagcaggtggggaccggagactgtaccaaatgattgaagaagcgagagggacattaagctgagttaattctttactgggacctaattaagggctcatttccagattaaagtcatcggaccaatctgaaaaatagtcccaaagagaggagttgaccctgtccttaatatgtagagatagaaaattttaaaaaaacataaaaaaacaaaaattatcctttcatacatttctaaagagcatatttgtcatgtatctcaagtaaatgggcagggcagccttacttcctcaccgacttgagacttttgactgctcgtcttggcatccattcttaagacaaatggttcacattgagttaaaataaaataaggcaagacatccaggtcagaaggaagtggcttccaagacctacacctctatgtcctttaaatggacctgtgtccctctactttatgttaaaatcctaggcacgatatgttgtcagccttagagactgataaataatagaaagtgctgtttggggacagcgtcctcataacagaggtccagaaaatactttcatctctgtctgcctcatgagaatacaagaagcccccagactgcatcctgggagagaacccagggcttccagttctatatttgcttgctttctctgcctttcatagaaacaattgctttctcccacttgttactcctctctcaccaggcgaaacaggccaaggtcaaaccagtttcacatttcaatgcaattgtgtaatatcttccaattagggctacagtgggagacaccacaaagggaaggacaggatttctctcaaatactactgaaaataacacatcttggtggccagagccatggacagtcaaaggtattgggcatttctcctctggttagcaaaactcagttgagttcttgtgtttctctcaagaaaccagtgggcgggttaggtagatcctccaaacctgcccatctccctcagaaaacttagagccattctcccagtactgtgaatgtttgctgtgccttggcatactttcatgggagaagagacagaagcaaaggttctgtccttcacgatgccatctctccgctcagcctgaatcagtcacgataatcctcaagatgactagaagaaaaggaggggctagtgacctccgaggaaagagtttggcagaagcagcttgagggagactgttgtgatgttcggccgtcccctcttgtgcgcatgcagctcctaccacagctaacctttacacctggtgctctagagacaaaggtaagttccacagctgttcgtacgctggggc

SEQ ID NO: 2127 - DNA, 585 bp, Rattus norvegicus
  Genbank Accession No. U37099
gaccagaattttgattacatgttcaagttgctgatcattggcaatagcagcgtgggcaaaacatccttcttgttccgctatgctgatgactccttcacgtccgcctttgtcagcacggtcggcatcgatttcaaagtaaaaactgtcttcaaaaatgaaaagagaatcaagcttcagatttgggacacagcaggccaggaaagatacaggaccatcaccacagcctattatcgaggggccatgggcttcattttaatgtatgacatcacaaatgaagaatccttcaacgctgtacaagattggtcaactcagatcaaaacatattcctgggataatgcccaggttatcctggccggaaacaaatgtgacatggaagacgaacgggtggtctcaactgagagagggcagcgcttaggagagcagctcgggtttgagttttttgaaaccagcgccaaggataacatcaacgtcaagcaaacctttgagcgcctcgtagatatcatctgtgacaaaatgtcagagagcttggagactgacccagccatcacagccgccaagcagagcacaagactcaaggaaacgcct

SEQ ID NO: 2128 - DNA, 2858 bp, Rattus norvegicus
  Genbank Accession No. U38376
gaattcggcacgagcggaactgtgaagggctcccatcaggctcccgactgacagagagctagaaggcacagagaaacctgaggattctcatttaactctgggaactgcttcaagaagctatagtaccagagaacacctgggaagtgtgagaattcctgcagctgggaccaaaatgtctttcatagatccttatcagcacataatagtggaacaccagtattcccataagtttacagtagtggttctacgtgccaccaaagtaaccaaggggacctttggcgatatgctggacactcctgatccttatgtggaacttttcatctctacaacccctgacagcaggaagcgaacaagacacttcaataatgatataaaccctgtgtggaatgagacctttgagttcattttggatcctaatcaggaaaatgttttggagatcacattgatggatgccaattacgtcatggatgaaaccctaggcacagctacatttcctgtatcttctatgaaggtgggagagaagaaagaagtcccttttattttcaaccaagtcacagaaatgattctggaaatgtctcttgaagtttcgtcatgcccagacctacggttcagcatggcactgtgtgatcaggagaaaacattcaggcagcagaggaaagagaacataaaagagaacatgaagaaacttttgggtccaaaaaagagcgaggggctttattccacacgtgatgtgcctgtggtggccattttgggttccggcgggggtttccgggccatggtgggattctccggtgtgatgaaggcgctctatgaatcagggattttggattgtgcgacctacgttgctggtctgtccggctccacatggtacatgtcaaccttgtactcccaccctgattttccagagaaaggtcctgaggagattaatgaagagctaatgaaaaatgttagccacaaccctctcttacttcttacgccacagaaagttaaaagatatgttgagtctttatggaagaagaaaagttctggccttcctgtcacctttactgacatctttggaatgttaataggagaaacactaattcaaaatagaatagtaccgaccttgagtagcttgaaggaaaaggtcagcgccgcccggtgtcctctgcctctcttcacctgtctccatgtcaaaccggacgtgtcagagctgatgtttgccgattgggtagaatttagtccatacgaaattggcatggcaaaatatggtacctttatgactcctgacctgtttggaagcaaattttttatgggaacagttgtaaaaaaatatgaagaaaaccccttgcatttcttaatgggtgtctggggcagtgccttttctatactgttcaacagagttttgggagtttctggcttacagaataaaggttctacaatggaggaggaattagaaaatattacagcaaagcacattgtgagtaacgacagctctgacagcgatgacgaggcccaaggacccaaaggcaccgagaatgaagatgcggaaagagagtaccaaaatgacaaccaagcaagttgggtccatcggatgctaatggccttggtgagtgactcagctttattcaatacccgagaaggacgtgctgggaaggtgcataacttcatgttgggcttgaatctcaacacatcgtatccactgtctcccctgagagacttcagcccccaagattccttcgatgatgatgaactcgacgcagcggtagcagatccagatgaatttgaacgaatatatgaaccactggatgtcaaaagtaaaaagattcatgttgtagacagtgggctcacgtttaacctgccgtatcccttgattctgcgacctcagagaggtgtggatctcatcatttcctttgacttttctgcaaggccaagtgacaccagccctccattcaaggaacttctgcttgcagagaagtgggctaaaatgaacaagctcccttttccaaagattgatccttacgtgtttgatcgggaaggattgaaggaatgctatgtgtttaaacctaagaatcctgatgtggagaaggattgcacaaccattatccactttgttctggccaacatcaacttcagaaagtacaaggccccaggtgttctgagggaaaccaaggaagagaaagaaatagctgactttgacattttcgatgaccccgaatcgccattttcaaccttcaacttccagtatccaaatcaagcattcaaaaggctacatgatctgatgtacttcaacacactgaacaacattgatgtgataaaggatgccattgttgagagcattgaatacagaagacagaacccatctcgttgctctgtttccctcagtaatgttgaggcaagaaaattcttcaacaaggagttcctaagtaaacccacagcagagtccatttgaattccatgactactggagttcagagcacatgagagatcatcttactatgcacaagagactgactgctactcagagttgtggggacggaggcgtgtgttaggtgaaaacggtgttgattatgcaatacttggcaacagtttctgacagtatgaattttttgacataagcatagggctatatactgtattttaaacattcctcacatttttacctgagcatttttatatatatataaaaatatcctttccttttataaatattaatagtttaactcagtaaaaaaaagcttcccattgtgtgtgaatgttattctgaactagatttgttcatgccatgttacaacactatttttatttaaatgttcatatctacacatgcgaaataaatactttgatatacaaattgccaaaaaaaaaaaaaaaaaaaa

SEQ ID NO: 2129 - DNA, 3326 bp, Rattus norvegicus
  Genbank Accession No. U41164
acttccgggtttagccggcagcgcagccatttgtgtgtgtgtgtgtgtgtgtgtgtgtgtatgtgtgagtgtgtgtgtgtatgtgtgtgtgcgtgcgtgtgtgtgtgtgtgtgtatgtgtgtgaaggcgccttcagtggcccggctttgtggctgggctcagtctgcacggagcgacctagcggatgctgactcgaagtggaggccagaccccggccactcgaatcatgtcggatgtgcttcaggatcggggcaggaagcgcttggcaccacgccacacccggaggggaccatggagcagcaagatgatgagtccccggagaccctgcaggcctgtgtggagaactttgttctaccccaagagatgatcatcgaagtggagggagaagatgctgggtcactggacatcttgcctcaggagagcacagacttcaagattgtgactgtggacctcacggaggagggacagagcacttggagcaaggcccagagaaccccagagagacctgtgaccctggcaggccctggaagggacctgtgggattcgacagctgtacacagaacagaagaaacaacctcaaagcagaccgtctttgatgaagaaccatcccatggatcgaagccagaggtgttggcaagagatgatccttggctttcttcatgtgaggagcagttggagaaacaacaggacaagcaagaggagggggtcttgacccagggtagtgctggtcctcccgagactgtctatggggatcctggctttgacaggagttgcctgagtaccagccggccttcattccccatgatacctctcagaaaccattttcataaacaagcgtcacatgttaaaaagttacatggtgatgttgcaaatagtcaccaacagatcaacaacaatgcggatttctttgaagatgacaaatctgggaaagttcctcagagtcttcatcccactcagtgtataagaaccccgaaaggaaagaaagcctgtgaatttaatggtcgtgttcaaccctttggccaaggtgtgcccctaaatctaaatcaaaaagttcatttggaaggtaaaagctttggctttaaagggcgcgggcaagttttgaaccgtaacatagtcctcaatgagcaacagaagcttctcattaaagaaggccagtataaatgtagcaaaaccgccccaagtccgtctcttccccaaaacctgagaaactactctgaggagaaacgctttgaatgtaagtactgtggcaagtccttcagctggagctcccatctcattgctcaccaaagaacccatacgggggaaaagccgtacaaatgcaacctgtgtgggaagttcttcacccggagctcacacgtcgtttctcatcagaggattcatactggagagaaaccatacaggtgcaatctgtgtgggaagtctttcacccagaggtatgtgctcgtggtgcatcaaagaactcacactggcgagcgtccttatgaatgcaaccagtgtgggaagtcgttccgccagagctacaaactcattgcgcatcaaagaacccacacaggagagaagccgtacgaatgcacccagtgtgggaagtcattcatccagagttacaagctcatcgcgcatcagaaaattcactctggagaaaaaccttatgagtgcagtcactgtggcaagtccttcagccaaagctataagcttgttgcccatcagaggactcacacaggagagaaacccttcgagtgtaactactgtgggaaatcattcagctggagctcccagctggtgtctcatcaaagaacccacacgggagagaagccttacgagtgtaacgagtgtgggaaatcattcaatcgcagctcacaccttgtcatgcaccagagaactcatactggagagaagccgtatcagtgcaagcagtgcgggaaatctttcagtcagagttacgttcttgtcgttcaccagaggacacacactggggaaaagccctacgagtgtggccagtgtgggaagacattccggcagagctcctgctttacccagcatcagaggactcacaccggagagaagccctatgagtgtaatcagtgtgggaagaccttcagcctaagtgcccggcttatcgtccaccagcgaacccacactggggaaaagccctacaaatgcagccagtgtggcaaagcctttattagcagttctaagcgcagtaggcaccaggctactcacagcgaggagtcctgcaagtcctgaccagttgagagtctgagctggagttgactcctgtcagtccaatcctctgaagttccgtctgaaggaatgcacttgaccagaagtgtcagtgtgagaagaatgcacacaggcctttcctcaccccgtgtcagtgacagaaaggagtaagtaaggccttcggtttggcagatgtggataagaggtccctgtagaagaaaagctgttacaccctggcagtggcgcgtactaggatgactgcaggcatcgtccctaagccaatctcaaaaggccacctttaactgtcagaaatcgtttcccaaagcactctgtgtacagagaaggcagaagctagacttagaaaaactgaatgctagatcaaatactgcaagcttagtgcagaagccctcttgttggtgagttcggcctggtccttgagagcacagcttctctgttgcaaagctggcaccctgtagatttcgttcaggaggtgtgcattctaaatgctcttacttagggaagttaactgctggccagcagctttgctctcctcctgctggctcttttccttcatgctactaggtggctaagccacgacctcccgccttatccccccgtgcagagtcctcatacctactcacttcaggcaggtgagccattcgatccctcatttatgcaggcttaaccagtcaggttccagtcatagccaaacgtaagctcacttcggagtaccctactgctcttcaaaggagctgcttttctatcgcaaagatttctcttatgctgtccttactagtcattccgtgccatcaggagacaacataggagtcactgccttagagtgacaggtggccattgagttgtcggggccctagtctgctaaaccaagctcatctgagccaaggaatggactcccttgtcctcaaagccccctacagtattgctgtggatgctggccatgagctggaagggtcaggaaatccacaagcagggttaagcttggaccagcatggaggtgaacctgtgctaaaaacccatgactagtgaggctgagtcaagaggcttgttcaagccagcctgtgttacatagcaaaactgtcttgaaa

SEQ ID NO: 2130 - DNA, 347 bp, Rattus norvegicus
  Genbank Accession No. U42719
cagacccgcaactttctggtccgggcttcttgccgccttcgtttggagcctagcaaagagtacttaatcatggggatggacggagtcaccagtgacctcaagggagacccccagtacttgctggactcaaacagttggatcgaggagatgccatctgagcacctgtgcaggagcacccgtcagcgggcagcctgtaccagctcaatgacttcctgcaggagtacagaagccaggggtgccaggtgtgagggcgtcggactctggatccctgagctcagccccagggtcagggcctctcacgaagcagggcctgcttaacagggtaaataaataaaacttttgacagt

SEQ ID NO: 2131 - DNA, 197 bp, Rattus norvegicus
  Genbank Accession No. U47315
gggacaaaactttataactacaagcacttaagcctcaaaattcttgactttttctttaatgactatagtataaccctcagttggtcacatgtctacacattatttccagttgataacaagtagcggtgttttccatatgtaattcagatctgaacttaatggcaataaatggtttaaatatttgcgaaaaaaaaaaa

SEQ ID NO: 2132 - DNA, 2006 bp, Rattus norvegicus
  Genbank Accession No. U53184
gcgcgcgcggccagcgagacctcccggctccactggcggcgcgggcggcggtaaaatgtcggctccaggaccttaccaagcagctgcaggcccttctgtaatgcctactgcacccccaacctatgaagaaacagtgggtgtcaacagttactacccaacgcccccagcacctcagccgggaccagccacagggctcattacgggcccggatgggaagggcatgaatccaccttcgtactacacccagcccgtgcctgtccccaacgccaacgcaattgcagtgcagacggtttatgtgcagcagcccatctccttctacgaccgccccatccagatgtgctgtccttcctgcaacaagatgatcgtgacccagttgtcctacaatgcaggagccctcacctggctctcctgtggcagtctgtgtctgctgggatgcgtcgctggctgctgcttcattccgttttgcgtggacgccctgcaggatgtggaccattactgccccaactgcaaagcgctcctgggcacctacaaacgtttgtaggactcggccagccacaggggaggtagacaagtgctcccggaagtcacccaacccttgcccagcgcagccagaagacgtcccttccttgatctcttcatgagctcgtcttcgtgtcttttagggggtggggaaagtcggaaaagtaacaaacccccaaacccagaaactgctgctggagttgtgccctgcacatgcaaagacgtggaccttgggtgttgctttaagggtttaccgcctgatctcgttaccccactaactgtgattgttactccatttgcatctcgtctgctgatttgccactgcctgccccctcttcctcaagaagaggccttcctggtgccaggctcaaaacccgaagctacagtttgccttatttttcactgtttggcttgatctgtaccatctctcccagccctaatgacagagaccttgccttaaagactttgcggttctgtaattgcagacttctccagcactcagaatcactttcaattccatagagttgttcctctccacacacacccctcccccggtgcacagaagggctgccgacacccaccagactcatacagagaaggtcacaagtactaaatgaaaggctcccagcccaccttgtctcagcccctgtcctgtgaagggactccttcctcacacagtttctgtgacttccttttgttcttaaacacatggaagttacttggcagggagacatttctagaataatttttgtgatcacgatacacccttcattctccgtttgctggtatgtttttagttggtttggttttagttttccacatacagtctagctcgtggccagccttgagctccgaggagatcctccatcttctcctctcaaatacccagggcccagacatttgcctctgcacctgctgggctttttctctcatttttccttaaccagaaaaacaaacgggtaatttcatcgactgcctatgtaggtttggtgtggttttgaaaaccttgtttccatggggccctttgggggagtcagggggcccctgcacgagcccatgcttcaatgccgagagattggctgctggaaccccctgaagcatgatttcatgttttagagatgagcttctgtggtacggtcatcatggtctccaacatcaacagacaaggtagaaggatgtcaacgacaaagataagttcagggctctttctagggtcaccactctgtcctgtgtaacactgacacagtctggccagcctttcaggaggtcctggctccctcctaaacccatgtaggwcttgctgcaagtaacagtgtatgaagtcaacctgacctggaacagaagtctgcatattggttaagatacagcctatgtatcttcatacaacgatccagaagtactagacatcatttttgcagtgaattatgggtaccatacatgactttgatgatatctgcttttaaacaaataaaatctttgatcactca

SEQ ID NO: 2133 - DNA, 3003 bp, Rattus norvegicus
  Genbank Accession No. U57391
gcgcccgccccgagagggtagcagatagtccctcggagtctccgccccaggggcatgtggagggtgtccaccgattaggatcgggtccgagtgattgaccacggggcccggagggtccgaacctggagcgcagcctgcaccctccaccacccgcccttctggaatgtcagaactaagccaagaggcaggtgcaccggaaaattgtgactgagccttcttggcagaagagaaactgagtcaccagtccaggaaccgcagggctgttggcgctcacctcgagtcttctggctgctttcctatttgctccctgcaggctccccctgtcctcctcctggggcacatcatgaatggtgccccttccccagaggatggggttttcccttctccaccagcgctgccaccaccccctcccccaagttggcaagagttctgtgagtcccatgcgagggctgctgccctggatcttgctcgccgttttcgcctctatctggcctcccacccacaatatgcagagccgggagcagaggctgccttttctggccgttttgctgagctcttcctgcagcacttcgaagctgaggtggctcgggcctcgggctcactctccccacctgtcttggctccattgagccctggtgtggaaatcccaccatcacatgacctgtcccttgagagctgcagggtgggtgggcccctggcagtgttgggcccttctcgatcttctgaggacctggctggaccccttccttcctcagtctcttcctctacaacgtcctcaaagccgaagctcaagaaacgcttctccctccgctcggtgggtcgttcagtcagaggttctgtccgaggcatcctgcagtggcggggggctgttgaatctccctcccaagctgggcctctggagaccacatcaggtcctccagttctaggtggaaacagcaactccaactcctctggtggtgctgggacagttggtagggcattggccaacgatggcacatcccctggggagagatggactcatcgctttgagaggctaaggctaagtcgtggagggggaaccttgagagacggagcaggagtgatacagagagaagagctgctgagtttcatgggggctgaagaggctgcccctgacccagcaggagtaggtcgtggaggaggggcagctgggctgacctcgggaggaggagggcagcctcagtggcagaaatgtcgattactgctccggagtgaaggagaaggaggaggaggaagtcgcttggagttctttgtaccacccaaggcatcccggccccgtcttagcattccctgttctactattactgatgtccgcacagccacagccctggagatgcctgacagggagaacacgtttgtggttaaggtagaaggcccttcagagtacatcctggagacaactgatgcacttcatgtgaaggcctgggtgtctgacatccaagagtgcctaagcccaggaccctgccctgctatcagcccccgtcccatgacccttcccctggcccctgggacctccttcctcacaaaggataacacagagagcctggagttgccctgcctgaatcattcagagagtctgcctagccaggatcttcttctgggacccagcgagagtaacgaccgcctgtcgcagggagcttatggaggcctctcagaccggccgtcagcgtccttctcccctagttctgcctccattgctgcttcccattttgactcaatggaactgcttcctccagagttgccccctcggattcccattgaggaggggcctccagcagggacagttcatcccctctctaccccgtaccctcccctggatactcctgaagcagccacagggtcattcctctttcaaggggaggcagaggggggtgagggggaccagcccctctcaggctacccttggttccacggcatgctctctcggctcaaagctgcccagttagtgttagaaggaggtaccagctcccatggtgtcttcttggtacgccagagtgagacaagacgtggtgaatatgtcctcactttcaacttccagggcaaggctaagcacctgcgtttgtcactaaatgaggagggtcagtgccgggtccaacatctgtggttccagtccattttcgatatgcttgagcacttccgggtgcaccccatccctctggagtctggaggctccagtgatgttgtccttgtcagctatgtgccctcccagcggcagcaggaacggagcacctcccgtgatccaacccagccctctgaaccccctccatggacagatcccccacatcctggggcagaagaggcgtcgggggcgccagaagtggcggcagccacagccgcagcagccaaagagaggcaagagaaggagaaagcgggcggcggaggggtccaggaagagctggtccccatggctgagctggtccccatggctgaattggaagaggccatagcaccaggcactgaggctcagggtggtgctggctctagtggggacttggaggtgtccctaatggttcagctccagcagttaccactagggggcaacggagaagaagggggtcacccccgagccattaataaccagtactcatttgtctgagatacctgcccaccctccattttcctgctcccagccttaagttgtgagactgggctgggtaaggacacagaggaaagtgggagtcccctccctacatgcttcctgacccttgtcagccaagggtgtgtatgttggtacaagtagaggttcaagagcccagttaagtccccagttactacactacaggtgcccttgccccgaggccaaggacttgggctccattacctccctgaggggctcttatggtcagccccatccctgggggctgtttcccccactaataacccccaacccaagcaagggtgagggggaagggctgtcagttatattaaggttgttgttgttgttttaaaccaaatggaaaagcataaataaataaagggtttatc

SEQ ID NO: 2134 - DNA, 2481 bp, Rattus norvegicus
  Genbank Accession No. U62316
tctcactatagggctcgagcggccgcccgggcaggtcggctggcgaggacacgtcaggggacataaataaataaataattccattcagcggatgacagcgaggcgaggcggctgcagctgggcggggggaccgggagagcagcggtgcgcaccgggtgtcagagccagagctgaggaccgaacccagggccttgcacttgctaggttgttttcgtctccagtagaagctcagaaatgccatcagagtcttcagtaaaggcaacggcggcgccgcctccattcccacttcctccggacggagggtggggctgggttgtagtctgcgcatccttcatctccattgggttctcctatgccttccccaaagccgtcacggtattcttcaatgacatcaaggacattttcaagaccacctccagtcagatcgcgtggatatcctccattatgctggctgtcatgtacgcaggaggtcccatcagtagtgtgttggtgaataactatggcagccggcctgtggtgatagtaggaggattactgtgctgtactggaatgatcttggcttctttcagcagcagtgtgatagaactttacctcaccgtcggcttcattggaggtttaggattagcattcaacctgcaaccagccttaacaataatcgggaaatacttctataggaagcgaccccttgcaaatggctttgccatggctggaagtcctgttttcttaagcacactggctcctttcaatcagttcctatttaacagctatggctggaaggggagttttttgattttgggggccatatttttgcactcctgtgtggccgggtgcctcatgagacctgttgggccaagtccacgtgctgcgaagtctaaaagtaaggttggctcaagacaagattcaagtacgaagagactcagtaaggtatcaacagcagaaaagattaatcggtttttagatttcggcctttttacacatagaggatttttgatctacctgtctggaaatgtcgtgttgtttttagggatgtttgcccctattatattcttggctccgtatgctaaggacaaaggagtggatgactataattcagctttcttgctgtctgtgatggcttttaccgatatgtttgctcggccttcggtaggattaatagccaacactagcttaatccgtccacgaatccagtacttgttcagcgtggcaatcatgttcactggcatatgccatctcctctgccccctagcccattcctacacagctttggtggtctacgttatattttttggaataggatttggaagtattagcagtctcctctttgaatgtcttatggaccaggttggagcctccaggttctccagtgctgtggggctcgtcactatcgtggagtgttgcccagttcttcccggccctcccctggctggtaaattgctcgatataactggacaatataaatacctgtacatagccagtgggatagtcgtgttatcatcaggcatttacctactgatttgcaatgctataaactatagacttctcgagaaggaaaggaagagagagaaagcaaggaggaagaaatcagcctcgcaggcatccaaagaaatggaggctttgagcagatctaaacaggacgatgttactgtgaaagtttcaaatacacacaatcctccctcagacagggacaaagaaagtagtatttaacaagtctcatctccgaatcagtgttcagaaatttaattatgagtttctttgtgtttttttcaatgaattgcaaaggattttagctgcaacaaaagatcgcaaacagtaacgaaactggtatcttcctcaatgacgaactaaaaatcagtgctttaatatttgttaaagatggttaacttttgagattgtgcacataaaaaatccacacagctgcttatctgcacaccaaagctgtgatgaaaatgaatttttttaaatcttctgccaacttttacttttagctatagaatgagatctgcatcccagaccccggctgacctaagcacaattcaacattaattccacataactaccctcttcaaggttcatttttcgtcggatactaagtcatgaagtgaattgaagacaatcattctttctattcaacacacaaagaattacacatgtagccacgcaaacactgagtaacgggatatcataaagaaataaatgaatttgagaaaattattatcatagtcatttttaagtcaaaggaaataagactctggcaagtgggaatgtaatatatttgtgtgcagtcatccagtgtggtttccaaataacagtctatgttgaaaattcaagtgttattaactcaaaacacgctaaaggggaaactatctacagtgggtgagtttggctaaacccccacacagctctactagttttcaccatcactctgccacatttgtgcctattttatccacatcacctgtctgcactgtttcagcacaatag

SEQ ID NO: 2135 - DNA, 3348 bp, Rattus norvegicus
  Genbank Accession No. U67140
gaattcggcacgagcggcagcgtgctggagggatgtgtgtcgcagtcctcagtcccacacccgcttccgaggtgtcatctgcagcatacttgccggctaccatttttcctgtgcacgcgtctccctggttggacagctgctgcctgggacaggtgacaccagtgcccaactagggcaaaggcccccgccccgtgggccaggatcatgaaaggcctcggtgacagccgcccccgccacctctccgacagcctggacccacctcatgagcccctctttgccgggcctgaccgcaacccctacctgctgtcgcccaccgaggcctttgcccgggaagcccgtttccctgggcaaaacacactgccgggggatgggctcttcccactcaacaaccagctgcccccaccaagcagcacctttccccggatccactataactcccactttgaggtgcccgaggaaagtccgttccccagccatgcccaagccaccaagatcaaccggctgcctgccaacctcctggaccagtttgagaaacaactgcctatccaccgggatggtttcagcaccctccagttcccccggggcgaggccaaggcccggggtgagagtcctggccgcattcgccacctggtccactccgtccagcgtctcttcttcactaaggcaccctcgatggagggcaccacgggcaaggtgggtggcaacggcggcaagaaaggtgtcctggaggacgggaaaggccggagggccaaaagcaaggaacgggccaaggctggggagcccaaacggcgaagccgctccaacatctcgggctggtggagttccgatgacaacctggacggtgagggtggtgccttccgcagcggccctgcctcggggctgatgactctgggccgccagccagaacgtacccagccccgctacttcatgcacgcctacaacaccatcagcggacacatgctcaaaaccaccaagaacactaccaccgagctgactgccccaccacccccgcctgctccccctgctacctgtcccagccttggagtgggcactgacaccaactatgtcaaacgtggttcatggtccactctgaccctcagccatgcccacgaggtctgccagaagacctcagccactttggataagagcctgctgaagtccaaatcctgtcaccagggtttggcctaccattacttgcaggtgcccggcggagggggagagtggagcaccacgctgctgtcccctcgagatatggatagcaccgctgaggggccgatcccgtgccggcgcatgcgcagtggcagctatatcaaggccatgggcgacgaagacagtgatgagtctggaggtggtagccccaagccttctcccaagactgcggcacggcgtcagagctatctgagggccacgcagcagtccctgggagagcagagcaacccccgcaggagcttggaccgcttggattcagtggacatgccgctgccgtccaagtaccccagctgggaagaggactacaaccccatcagtgacagcctcaatgactccggctgtatcagccaggtttttggacaggcttccctgatccctcagttgtttggccatgatcaacaggtccgggaggcagacctgagtgaccagtatgaggcagcctgtgagtcggcctgcagtgaggctgagtcgacagccgcagaggcgctcgacttgtcgctgcccagctacttccgctcacgcagccacagctacctgcgagccatccaggcgggctgctcgcaggaggaggacagtgtctccctgcagtccctctccccaccgcccagcaccggcagcctcagcaacagccgtacacttccaagttcatcatgcctagtggcatataagaagaccccaccaccggtccctccacgtaccacatcgaaaccgttcatctcagttaccgttcagagcagtactgagtctgctcaggacacctacctggacagtcaagaccacaagagtgaagtgacaagccagtcgggcttgagtaactcatcagacagcctggacagcagtacccggccacccagtgtgacacggggtggaattacgccaggccctgaggctccagagccaccccctaagcatgcagctctgaagagtgaacacgggacactgacgagctctgagtcccactccgaggccgtccccaaaaggaaactgtcatcaataggaatacaagttgactgcattcagccagtgccaaaagaggagcccagtcccgctaccaaattccagtccatcggggttcaggtagaggacgactggcgaagcagcgccccctctcacagcatgtcctcccgtcgggacactgactccgatacccaggacgccaatgactccagttgtaagtcatctgagaggagtctcccagactgtacctcacaccccaattccatcagcattgatgctggcccccgacaggcccccaagattgcccagatcaagcgcaacctctcctatggagacaacagcgaccctgccctggaggcatcttcgctgcccccacccgacccttggatggagacttcctccagctccccagcagagccagctcagccaggggcctgccgcagggatggctactggttcctgaagctccttcaggctgaaacggagaggctggaaggatggtgctgtcagatggacaaggagaccaaagagaacaacctctctgaagaagtcttaggaaaagttctcagtgctgtgggcagcgcccagctcctgatgtcccagaaattccaacagttccgtggcatttgtgagcagaacttgaaccctgatgccaacccccgtccgacagcccaggacctggcagggttctgggacctgctgcagctgtccattgaggacatcagcatgaagttcgatgagctctaccacctcaaggccaacagctggcagctggtggagacccccgagaagaggaaggaagagaagaaaccaccccctccagtcccgaagaagccagccaaatccaaggcggcagtgagccgcgacaaggcctcagatgcgggggacaagcagcggcaggaggccagaaagagactcctggccgccaagcgggcagcatctgtgcggcagaactcggccacagagagtgcagacagcatcgagatttatgtccctgaggcccagaccaggctctaaggccacaaaggagaaagcactcattttaaatcattaaaaactcaatgcaaacggaacagcgtttctcaccctttggtatggttattatctctagagaccctgagccaactttccaattgacacgtacaagggctcacaaggtggcttttctctcgtgccgaattc

SEQ ID NO: 2136 - DNA, 1142 bp, Rattus norvegicus
  Genbank Accession No. U70049
ccacctcagcgagcctgggcgcaggagaacccacagcccggtggcctgcgccccgccgccccgcgcacagaccgcaccctcgcctcctttaaagctcggggtgcccccagcacccccccacggccccaccccaccgcgagccccgaccctcatgcatatgcaggtgcgcgggtgacgaatgggcgagcgagctgtcagtctcgtcccgaacttgttggctgcggtgccgggagcgcgggcccagagccgaggccaggacccgccgccgccgtcgccgccgccgccgccgccgccgggtgggagccgtgccgccgccggagagcgtgcagtaagccggagccgccgcctcccctgcgcgcgcgccgacgcagccgcggcactgctcgaccccgcccgcgccgcctgtgccggcgccgccgcctgtgcgccgccgggctcggagggcgggcgggcgctggaggccggcgcggcggctatagcgggcgcgggcggcggcggcggcggcggggccgcggcggggtcgaggcggcgatgcgggcacgcggctggggacgcctgcctcggcggctgctgctgctgctggttctatgcgtgcaggtgagcggggcgcgcggcggcgacgggcgcggacggggcgcaccgggccgggccgctcctccgggccaggcggcgcacaagcggccgcggtccggagccttaggaacggcgcgagggtgggggcggggtggagtcggcgaccccggcccgcgcctccctgcactctgagctgccttatttttaggcgacgcggcccatgggctatttcgagctgcagctgagcgcgctgcggaacgtgaacggggagctgctgagcggcgcctgctgtgacggcgacggccggacgacgcgcgcggggggctgcggccgcgacgagtgcgacacgtacgtgcgcgtgtgccttaaggagtaccaggccaaggtgacgcccacggggccctgcagctacggctacggcgccacgcccgtgctgggtagcaactccttctacctgccgccggcgggcgctgcgggagaccgagcgcgcgcgcggtctcggaccggcggccaccaggacccgggcctcgtcgtcattccctttcagttcgcctggccggtacgtgcgc

SEQ ID NO: 2137 - DNA, 178 bp, Rattus norvegicus
  Genbank Accession No. U75404
tttttgattgtactcttctatgctggaccgaattcatatgcagatcgaagtcactcctgttctttacagatggtattttgatagatactggagtttgtctgtgttatatctgtccccttctttaagaacaatgttgcattacgttcctttggataaattgtgatttgacaactgattt

SEQ ID NO: 2138 - DNA, 519 bp, Rattus norvegicus
  Genbank Accession No. U75925
  misc_feature (1)..(519): n = a or c or g or t
gggtcccagtttgacctcagactgttgtgctggcagcganaatttcaggccagtggagcttagcttgctgggctccactggggtgggatccactgagctagaccacttgtctccctggcttcagctccctttccaggggagtgaacggttctctctcactggtgtttctggtgccactggggtataaaaaanaaactcctgcagctagcttggtgtctgctcaaatggccgcccagttttgtgcttgaaacccagggccctggtggtgtangcatctganggaatctcttantctgtgggttaagaagaccgtgggaaaagttgtantatctgggccagaatgcaccattcctcacaacacantccctcacgggttcccttggctaagggcaagattccctgacccttgtccttccaggtgaagcaatgcccccctgcttcttccggtcncctccatggaatcntcctttctancatccatgaaaaaacngttnccnttggaatgccaaancccccccc

SEQ ID NO: 2139 - DNA, 2129 bp, Rattus norvegicus
  Genbank Accession No. U76714
gaggccgctcgagagcaggcttagggtctactgcggccggtggaccctccaacccgcttccataaggctttagctttccaacttcagctacagtgttagctaagtttggaaagaagacataaagaagaccccggtgggcagctttgctgttctttgccttagttgtcctttggggtctttcggcacaaggctgctgtgcttatagccgtgctatctccggttcctcacactcctgtgaagaagccctgggcaagagcagctaaagctactagcatccgaacaaacaaggggagagcgtctggtgccatgaccaagtcaagagatcagacccatcaggaaggatgctgtggatctttagcaaactacctgacctcagcaaaattcctcctctaccttggccactctctctccacttggggggatcggatgtggcactttgcagtgtctgtgtttctggtggaactctacggaaacagcctcctcttgacagctgtctacgggttggtggtggcaggctctgttctggtcctgggagccatcattggtgactgggtggataagaatgccagacttaaagtggcccagacgtccctggtggttcagaatgtatcagtcattctctgcgggatcatcctgatgatggttttcttacacaagaatgagcttctgaacatgtatcatggatgggtccttactgtctgctacatcctgatcatcaccattgcaaacattgcgaatttggccagtactgccactgcaattacaatccaaagggactggattgttgtcgtagcaggagaaaacaggagcagattagcagacatgaatgctaccattagaaggattgaccagctaaccaacatcctggcccccatggctgttggccagattatgacattcggttccccagtcattggctgtggtttcatttctggttggaatttggtgtccatgtgtgtggagtacttcttgctctggaaggtttaccagaagacccctgctctggctgtaaaagctgctctcaaggtagaggagtcagaactgaagcagctgacctcacctaaagatacggagccaaaacctttggagggaactcacctaatgggtgagaaagactctaacatccgtgaacttgaatgtgaacaagaacccacctgtgcctcccagatcgcagaacccttccgcacttttcgagatggatgggtctcctactataaccagcccgtatttttgggctggcatgggcctggctttcctctatatgacagtcctgggcttcgactgtatcgccacagtatatgcttacactcagggactgagtggttccatcctcagtgttttgatgggagcatcagcaataactggaataatgggaactgtggccttcacttggctacgtcgaaaatgtggccttgttcggactggtctgttctcaggactggctcagctttcttgtttgatcttgtgtgtgatctccgtgttcatgcctggaagccccttggacctgtctgtttctccatttgaagatatccgttctaggtttatacatgaggaggcagtgtcctcaactaccaaaatacctgaaacggaaatgcttatgtctaatgtgtctaatgttgtcaataccgtccatgagatgagtactaaatccgtccccataatctccgtcagcctgctgtttgcaggagtcattgctgctagaatcggtctttggtcctttgatttgactgtgacacagttgctgcaagaaaatgtaattgaatcagaaagaggcattatcaatggtgtgcagaactccatgaactaccttctcgaccttctgcatttcatcatggtcatcttggccccaaatcctgaagcttttggcttgctagtattgatttcagtcycctttgtggcaatgggacatcttatgtatttccgttttgcccsgaagactctgggcaaccagatttttgtttgtgctcctgatgaaaaggaagttacagatgaaagtcagcctaatacatctgttgtgtaaaatagtttagctgtggcccctgttactagatttgtggagagcatgtgtgcttattttgtactacagaattccaataaatgcctgcacttttaaaaaaaaaaaaaaaaaa

SEQ ID NO: 2140 - DNA, 429 bp, Rattus norvegicus
  Genbank Accession No. U77829
gtgaggcgaagctgagcaggaatggccctgtggacctctgtgatgggacatctggtggaatctcacaggcagttctgtggcaaagatggatgaaagctaaggactcatgaggaagctggataactgaacaaagccatgtacaagaatgggaagccagaaaatgggatggtggagtttgaatcaggtggacagttctaaaagtacaaatgatttcgtataaaggtaccacatgtgggtccctttaactgaaggcatggcaagctccacacaaggtccttcatttctgaatttcaagggctcctctgacaagtggacagtgcagtgggtgcaccttttccagaggtgactggatggatgcttgaacagaagatttgccaaatagacattgtgctgtcaagaattttaccattaaaagtgcattattgtagc

SEQ ID NO: 2141 - DNA, 564 bp, Rattus norvegicus
  Genbank Accession No. U82591
gcgcgcgcgcaccgcgggcgatggcggcatccggggagcaggctccatgctccgtgtacttctgcgggagcatccgcggcgggcgcgaggaccaagcactgtatgcgcggatcgtgtcgcggctccgacgctatgggaaggtgctcactgagcacgtggctgatgctgagttggagccgcttggggaagaggctgctgggggtgaccagttcatccatgagcaggacctgaactggctgcagcaagcagatgtggtagtggcggaagtgacacagccatccttgggtgttggctatgaactgggccgggcagtagctcttgggaagccaattctgtgcctgtttcgaccacagtctggccgagtgctttccgccatgatccgcggagcagcagatggctcgaggttccaggtatgggactacgcagaaggagaagtggagaccatgctcgatcggtactttgaggcatatcttcctcagaagacggcttcctccagtcacccaagtgcctgaccaccctactgtattaaaaagaaaattaagatttaaaaaaaaaaaaaaaaaa

SEQ ID NO: 2142 - DNA, 2636 bp, Rattus norvegicus
  Genbank Accession No. U89744
ttcccggagaaagacgatgagtcagtcgtctggtggtaccagcactcccaccacaacagcgactcagcccaccagtacttcaactcagacacctgggacaactcagcttcttagtactaccagcactcctaccacaacagcgactcagcccaccagtacttcaactcagacccctgggacaactcagcttcctagtactaccagcactcccaccacaacagcgactcagcccaccrgtacttcaackcagacccctgggacaactcagcttcctggtactaccagcactcccaccacaacagcgactcagcccaccagtacttcatttcagacccctgggacaactcagcttcctagtagtaccagcactcccaccacaacagcgactcagcccaccagtactgcatctcagacccctgggacaactcagcctcctggtggtgccagctctcccaccacaacagtgactcagcccacyggtagttcatctcagacccctgggacaactcagcctcctggtggtgccagcactcccaccacaacagtgactcagcccaccggtagttcatctcagacctctgggacaactcagcctcctggtggtgccagctcttccacagtgactagcagcagtagcacaggttccaatgatccttgcaactctaacccctgtaaatcacctgcttcttgtgtcaagctgtatgacagctacttctgcttgtgtttagaaggctactactacaacaattcttcgtcatgtgtgaaaggaacgacattccctggagagattggcatgagcgtaaatgaaacaactgacttggaagataaaaactctgtgaactatcaaactttgcacagcagtgttgttaagttttttgaaaacacgtttaagaagactgactatggacagactgtgattcttaaagtgagcaaagactctttaatgtcatcaagatctgtgatgcgtgctgctacgcagacagtctatgtatcagtagtaaatatgtttggagaaaacacaaaggaggatgaagagagtgtagcttctgtgatcaaggaggcagttaagacggataacaatgtggaacgctatttccaacaagatcggtgtgattattatggctgtgtgaagagtggcagcaatgtttgccggaatggtttacaatgcacgtgcaaacctgggctggagagactgaacccgcaggttcctttttgtgttgctccaacatgttctgagccctgcagtgcagagaagaagcagctatgcttaaagaaggataatggagcgatggagtgtgggtgcatggcaggctaccggaaggcgaacgggaaatgtgaagagtgtccttttggctacagcgggatggattgcaaagaccaatttcagctgatcctcaccattgtgggaaccattgctggagctttcatcctcatcttgctaattgtttttatcgtctccatgaggtcaaagaacaaaaagaagagtggagaagagcagaatctgattgaggatgactttcataacctgcgaatgaggccaaccggcttctccaacttcggagcagacaccagcatcttccccaaagtcaaaacaggggtcccgagtcagacctctaatccctacgcaaaccaccgaagcatgcctcgccctgactactagaatgataagaatttggaaccttccctagcccagctcacatggtgatcttaaggacaaggagaaatggacagagacaaaggtttgacctccagcgttcctctgctccgtttgcttcaacctgtgtgaagaacgcagcttgctgaagatacaactatcaaattaaatgcacatggacactatgagcctttctttgtaagagttgattttctccagttagtacagaacactacagcggggattggtgtggggatttttctttcctggtgggccaacggttagtgtttccaatccagagggagcaccctcataatagctcatccctgagcagtgccactcctgagctctggactctggctacccttgaacagtcagctgcctgtgatagggcctcactccaaggagacaggcaagagacagaaacatctcccagctttytcaggaggactgtggggacccaggtaccttcacatgagaataaggaggcttggactagctctwtcttckgtgggaacgttcaagtctttgacatgttagttggtaggaaaagcagggaggaaaaacatgagcacaggtagtagagagagaccaaggaagctatgctgggaggctgagggagggagaaggtagcaggtagcatcttctcccttgatgaagtccctcctcaggcagcaaatgggtgctctcgggcgccgccatcaccaagacatagatcccgagaaacccataaaagcaggagtcagtgttgaagccactgtgacagcacaggcattctgtctaggactctgtcagargggccgggtgttgtccactcaatgacgcttcactgggcctcagcctgctccataatggaagcttagcagtggccaccaacatgttacacacacacacacacacacacacacacacacacactcacacactcacatacactcacacacactcacacaccccacacacacacactcacaagcggccc

SEQ ID NO: 2143 - DNA, 4413 bp, Rattus norvegicus
  Genbank Accession No. U90725
  misc_feature (1)..(4404): n = a or c or g or t
ggcgtcttgttcctgtttcgccacagttcctaccttatgagcttggattcctcacgctaataaaagaggagcagtaaaagctggcaggctgacagaggcaacctcaggacggactttctggctactgaccattttgctgtgtcttactaggattgtgtgtggacgtgagatcaaccatgagctccgttgcagttttgacccaagagagttttgctgaacatcgaagtgggctggttccacaacaaatcatagttgccacattaaattcagaagaagaaagtgaccctccaacctacaaggatgccttccctccactgcctgagaaagcagcttgcttggaaagtgcccaagaacctgctggagcctggagtaacaagatccggcccatcaaggcctctgtcatcactcaggtgtttcatgtacccctggaggagagaaaatataaggacatgaaccagtttggagaaggtgaacaagcaaaaatctgccttgagatcatgcaaaggactggtgctcacctggagctctctctggctaaagaccaaggtctctccatcatggtctcagggaagctggatgcagtcatgaaagcccggaaagacattgttgctagactacagacacaggcctcagccactgttcccattcctaaagagcaccaccgctttgttattggcaaaaacggagaaaaactacaagacttagaactgaaaactgctaccaaaatccagatcccacgcccagatgaccccagtaatcagatcaagatcactggcaccaaagaaggnatcgagaaagctcgccatgaggtccttctgatctctgctgagcaggacaagcgtgccgtaaagaggctagaagtggagaaggccttccaccccttcatcgctgggccgtacaatagacttgtgggtgaaatcatgcaggaaacagggacgcgaatcaacatccctccacccagtgttaaccgtacagaaatcgtcttcactggagaaaaggaacagctggctcaggctgtggctcgtattaagaagatttatgaggaaaagaagaagaagactacgaccattgcggtagaggtgaagaaatctcaacacaagtatgtcatcgggccgaagggcaactcactgcaagagatcctggaacgtactggagtctccgttgagatcccgccctcagacagcatctccgagactgtgatacttagaggcgagcctgaaaagctgggacaggcattgactgaagtctatgccaaggccaacagttttacagtgtcctcagtctctgccccttcctggcttcaccgtttcatcattggtaagaaagggcagaacctggccaaaatcactcaccaaatgccaaaggttcacattgagttcacagaaggtgaggacaagatcaccctggagggccccacagaagatgtgaatgttgcccaggaacagattgaaggaatggtcaaagacctgattaatcggatggactatgtagaaatcaacattgaccataaattccacagacacctcattgggaagagtggagccaacatcaacagaatcaaagaccagtacaaagtgtctgtgcgcatcccccctgacagcgagaagagtaacctgatccgaattgagggagacccacaaggtgtgcaacaggccaagcgggagctgctggagcttgcttctcgcatggaaaatgagcgcaccaaggatctaatcattgagcaaagatttcatcgcacaatcattgggcagaaaggtgaacggattcgagaaattcgtgacaaattcccagaggtgatcatcaactttccggatccagcacaaaagagtgagattgttcaactcagaggccccaagaatgaggtggagaaatgtaccaagtacatgcagaaaatggttgcagatctggtggaaaatagctattcaatttctgtaccgatcttcaaacagtttcacaagaatatcattgggaaaggaggtgcaaacattaaaaagattcgtgaagagagcaacaccaagattgaccttcctgccgagaacagcaactcggagaccattgtcatcactggcaagcgagccaactgtgaagccgcccggagccggatcctgtccatccagaaagatctggccaacatagctgaggtggaggtctcaatccctgccaaactacacaactctctcattggcaccaagggtcgtctgatccgctccatcatggaggaatgtggtggcgtccatattcactttcctgtggaaggttctggtagtgacactgttgtcatcaggggtccttcctcagatgtggagaaggccaagaagcagcttctgcacctggctgaggagaagcaaaccaagagttttactgtggatatccgggccaagccagaataccacaaattcctcattggcaaagggggaggtaaaatccgcaaggtgcgcgacagtactggagcccgcattatatttccggctgctgaggataaggaccaggacctgataacaatcataggaaaggaagatgctgtccgtgaggcacaaaaggagctggaagcattgatccagaacctggataatgtggttgaagactacatgctggtggaccccagacaccaccgccattttgttatccgaagaggacaggtattacgagagattgctgaagaatatggcggggtgatggtcagcttcccacgctctggcacacagagtgacaaagtcactctcaagggtgccaaagactgtgtggaggcagccaagaagcgaattcaggaaatcattgaggatctggaagctcaagtaacgctggaatgtgctataccccagaagtttcatcgttcggtcatgggtcccaaaggttcaagaatccagcagatcactcgggactacaatgttcaaattaagttcccagacagagaggaaaacccagttcacagtgtagagccttccatccaggagaatggagatgaggctggagagggcagagaggccaaggagaccgacccgggatctcccaggaggtgtgacatcatagttatctctggccggaaagagaaatgtgaggctgccaaggaagccctggaggcactggttccagtcaccatcgaggtagaggtaccctttgatcttcaccgctacatcattgggcagaaaggaagtggaatccgcaagatgatggatgagtttgaggtgaatatacatgtgccagcccccgaactgcagtcacacaccattgccatcactggccttgcagcaaatttggacagggctaaggcggggctactggatcgagtaaaggagctgcaggctgagcaggaagatcgggctttaaggagttttaagctgagtgtcactgtagaccccaaataccatcccaaaattatcgggggaaaaggggcagtgatcacacagatccgattggaacatgatgtgaacatccaatttcctgataaggacgatgggaatcagccccaggaccaaatcaccatcacagggtatgagaagaacactgaagctgcccgtgatgctatcctgaaaattgtgggtgagcttgagcagatggtttctgaggatgttcccttggatcaccgtgtgcatgcccgaatcattggtgccagaggcaaagccatccggaaaatcatggatgagttcaaggtggacattcgcttcccacagagcggagctccagaccctaactgcgtcactgtgacaggactcccggagaatgtggaggaagctatcgaccatatcctcaacctagaagaggaatatctggctgatgtggtggacagtgaggcgctgcaagtttacatgaagcccccagcacatgaagagtccaaggcaccatccaaaggctttgtggtgcgagatgctccctggacctccaacagcagtgagaaggctcctgatatgagcagctctgaagaaattcccacctttggggctcaagtggcccccaagaccctcccgtggggccccaaacgataatgatcaaaaagaaactttccagcctgctgcccaaacccaaccacacaatggtttgtctcaatctgactcagcagctggaccctcgtaaattgttgatgctccccctccccgaagtctcgcagcaaagcctggtgggctggccttctgtggctgcttcccctggcctggtcagcacccgcaggctcagggtctgctcctgacgctgtgctctgggaaagtgcacgccactgcgtgaaacactaagcaaggtaatcgagcatttcgtgatcacagactccagcttcctggtccacccagcatgtagtcagcattctgactttcacagcagagttccacagcggctaggagttgacttccttgtgtcatgacctcaggaaataaatttccttgactttataaaagccaaaaaaaaaaaaaaaaaaaaaaaaaa

SEQ ID NO: 2144 - DNA, 1047 bp, Rattus norvegicus
  Genbank Accession No. U96490
tttgggcaggacaaggcaagagaagcggctgtttcagtagtgtttgtacccagaactcagcgaggtctacccttgggtagagcgaacgtccggccatggcttaccactcgggatatggagtccacggttccaagcataggacccgggcagctccaaaccctcctccactcttcgatgatacaagtggtggttattccagccaactaggcggatacccagccccaggagctgatgtagccttcaatgtcaacaacctgcttggagacccagtggccaatatggctatggcccatggcagctccatagcatcccaagggaaggacatagtgcacaaagagctacaccgttttgtgtctataaacaaactcaagtatttttttgctgtggacacagcctatgtagccaagaagctagggctattggtcttcccttacacacatcagaactggaaagtgcagtacagtcatgatgtgcctcttgcccccacggaaagacctcaatgcgcctgacctctatatccccaccatggccttcataacatacgtgctgctggctgggatggcactaggcattcagaaaaggttctccccacagcatgtggggctttgtgagcgagacaggtactggtgtgggtgttaatggagtgttggctctgcttctggcctctacctggccaccgtacgcagtgaactgggcaccttccacctcttggcctagactggctacaagtatgtagggatgatcctcagtgtgctcacagggctagcttttcggcagtgatggctactacgtggccctggcctggacatcgtctgcactcatgtacttcactgtagatctttgcggactgcagcttgggtcctgacagcatggggggcccacccctcggcagcatctccagctgtacctgaccctgggagccgctgcctccaaccccttatgatatactggctgaccttccacctggtccggtgacccctggtcctttggtggcactgagttttccatacattgaagatttggtttccttaaaaaaaaaaaaaaaaa

SEQ ID NO: 2145 - DNA, 5779 bp, Rattus norvegicus
  Genbank Accession No. V01201
gaattcttggcaaccgaagtgctcagtccaacttcaatgatttattttagataagagactcctcatttcagtttagagtccaattaagcaacaaagttttaagagcagtcacataatgtcaataaaagcagaggtgtgtgtgtgtgtgtgtgtgtgtgtgtgtgtgtgtgtgtgtgtatgtgtgtatgtgtgtgtgctccttaatgatccattctttcatttccatgctgtagggagtgcaggtgcatgtaaatgttgtgtggggagagggaacacattacaggattacacttgaaactaaggagacagaccccacctctgggttacagtgaaaagtttagtggttaaaaacattttaataaaagtcagtggacttccctttactccagaaacacagccaatcatgccccaggatgttactagaacccctcagtaattgaaggaagtgtttttcaagctagctgcagtaacgccattttgcaaggcacggaaaattaccctggtaaaaagcccaaagcataggggaagtacagctaaaggtcaagtcgagaaaaacaaggagaacagggccaaacaggatatctgtggtcatgcctgggccggcccagggccaaagacagatggttcccagaaatagatgagtcaacagcagtttctagggtgcccctcaactgtttcaagaactcccacatgaccggagctcacccctggccttatttgaactgaccaattaccttgcttctcgcttctgtacccgcgctttttgctataaaatgagctcagaaactccactcggcgcgccagtcctccgagagactgagtcgcccgggtacctgtgtgttcaataaaacctcttgctatttgcatccgaagccgtggtctcgttgttccttgggagggtctctcctaactgattgactgcccacctcgggggtctctcatttgggggctcgtccgggatcggagacccccacccagggaccaccgacccaccaacgggaggtaagctggccagcgatcgctctgtgtctcgcttctgtgtctaactccgtaactctgactgtccctctgagtgcgcgcattttggtttcagtttgttccgggctgatcgctctgtgagcgacgtgtgagtagcgagcagacgtgttcggggggctcaccgcccggtaatcctgggagacgtcccaggatcaggggaggaccagggacgcctggtggacccctcggcagaggatcattgtgttctgatcccaccgccgcgtctagagaggcgcgctctgccatctgactctttctcttgcctctacgctactcgatctcgccgccgtttctggtttctttttgttttgtttctgataagcctctgtgtcggagtttctctcttcgaaatcttcgaaatgggacaaaataactctacccctctctcccttactctaggtcactggaaagatgtgagaacaagggctcacaatctgtccgtgaaaatcagaaaggaaaaatggcagactttctgttcctccgagtggcccacattcggcgtggggtggccgccggagggaacttttaatctctctgtcatttttgcagttaaaaggattgtctttcaggaaaccggaggacacccggaccaagttccatacatcgtggtgtggcaggacctcgcccagagtcccccaccatgggtgccgccctccgccaagatcgctgttgtctctagtccagagaacactcaaggaccatctgcggggaggccatccgctcctccccgaccccccatctacccggcaacagacgacttgctccttctctctgagcccccgccctatccggcggccctgccacctcctctggcccctccggcggtcggaccggcgccgggccaggcgcccgatagttccgatcctgagggaccagccgcggggaccaggagtcgccgtgcccgcagtccggcagacgactcgggtcctgactccactgtgattttgcccctccgagccataggacccccggccgagcccaacggcctagtgcctctacaatattggcctttttcctcagcagatctttataattggaaatctaaccatccttccttttctgaaaatccagcaggactcacggggctccttgagtctcttatgttttctcatcagcccacttgggacgattgccaacagctcctacagattctcttcaccactgaggagcgggaaaggattctcctggaggcccgcaagaatgtccttggggacaacggggcccctactcaactcgagaacctcattaatgaggccttccccctcaatcgacctcagtgggattacaacacggccgcaggtagggagctgctcctggtctaccgccggactctagtggcaggtctcaaaggggcagctcggcgccccactaatttggctaaggtaagagaggtcttgcagggaccggcagaacccccttcggttttcttagaacgcctaatggaggcctataggagatacactccgtttgacccctcagaagaggggcagcaggctgcggttgccacggccttcaccggacagtcagccccagatatcaagaaaaagttacagaggctagaggggctccaagattattccttacaagatttagtgagagaggcagagaaggtgtaccacaagagagagacagaagaagaaagacaagaaagagaaaagaaagaggcagaagagagagagaggcggcgcgataggcgtcaagagaaaaacttaactaggattttggccgcagtggtaagtgaaggagggtctggagataggcggacagggaacctaggcaaccgggcaaggaagacacctagggatggaagacctcctctagacaaagaccagtgcgcgtactgtaaagagaagggtcactgggacgaggagatcgccccggcgtgtactgggaggtagacttcacagaagtgaagcctggccggtatggaaacaggtatctgctggtattcatagatactttttccggatgggtagaagcttttcctaccaaaactgaaacggccctgaccgtctgcaagagaaattctaccccgcttcggatccctaaggtactcgggtcagacaatggcccagcctttgttgctcaggtaagtcagggactggccactcaactggggataaattggaagttacattgtgcgtatagaccccagagctcaggtcaggtagagagaatgaacaggacaatcaaggagaccttgaccaaattagccttagagaccggtggaaaagactgggtggccctccttcccttagcgctgctcagagccaagaatacccctagccggtttggtctaactccttatgaaattctctatgggggaccgccccccatacttgagtctggagggacattgggtcccgatgataattttctccctgtcttatttactcatttaaaggctttagaagttgtgaggacccagatctgggaccagatcaaggaggtgtacaagcccggtaccgtggcaatcccccacccgttccaggtcggggaccaagtgcttgtcagacgccatcgacccggcagccttgagcctcggtggaaaggcccgtacctggtgttgctgaccaccccgaccgcggtaaaagtcgacggtatcgctgcctgggtccatgcttctcacctcaagcctgcaccaccctcggcaccagatgagtcctgggagctggaaaaagctgatcatcctcttaagctgcgtattcggcggcggcggaacgagtctgcaaaataaaaacccccaccagcctatgaccctcacctggcagggggaccccattcctgaggagctctataagatgctgagtggccactcgattcgctccttcgatgacctccagcgcctgctgcagggagactccggaaaagaagatggggctgagctggacctgaacatgacccgctcccattctggtggcgagctggagagcttggctcgtgggaaaaggagcctgggttccctgagcgttgccgagccagccatgattgccgagtgcaagacacgaaccgaggtgttcgagatctcccggcgcctcatcgaccgcaccaatgccaacttcctggtgtggccgccctgcgtggaggtgcagcgctgctccggctgttgcaacaaccgcaacgtgcagtgccggcccacccaagtgcagctgcggccagtccaggtgagaaagatcgagattgtgcggaagaagccaatctttaagaaggccacggtgacgctggaggaccacctggcatgcaagtgtgagatagtggcagctgcacgggctgtgacccgaagcccggggacttcccaggagcagcgagccaaaacgacccaaagtcgggtgaccatccggacggtgcgagtccgccggccccccaagggcaagcaccggaaatgcaagcacacgcatgacaagacggcactgaaggagaccctcggagcctaagggcatcggcaggagaatatgggcagcgggtctcctgccagcggcctccagcatcttgcccagcagctcaagaagagaaaaaaggactgaactccaccaccatcttcttcccttaactccaaaaacttgaaataagagtgtgaaagagactgatagggtcgctgtttgaaaaaaactggctccttcctctgcacctggcctgggccacacccaagtgctgtggactggcccgaggggccctgcacgtggccctgagcacctctcagcgtagcctgcctagtccctagacccctagccagctccaaggggaggcacctccaagcaggccaggctacctcgggggtctagagcgccagaagaaccaaaactggtatgaagggtggttcaatagctccccttggttcactaccctactatcaaccatcgccgggcccctattactcctccttctgttgctcattctcgggccctgcatcatcaataggttagtccaattcatcaataatagagtaagtgcagttaaaattctggtccttagacagaaatatcagaccctagataacgaagataacctttgattccgctctaagattagagctatccacaagagaaatgggggaatgaaggaagtgtttttcaagctagctgcagtaacgccattttgcaaggcacggaaattaccctggtaaaaagcccaaagcataggggaagtacagctaaaggtcaagtcgagaaaaacaaggagaacagggccaaacaggatatctgtggtcatgcctgggccggcccagggccaaagacagatggttcccagaaatagatgagtcaacagcagtttctagggtgcccctcaactgtttcaagaactcccacatgaccggagctcacccctggccttatttgaactgaccaattaccttgcttctcgcttctgtacccgcgctttttgctataaaatgagctcagaaactccactcggcgcgccagtcctccgagagactgagtcgcccgggtacctgtgtgttcaataaaacctcttgctatttgcatccgaagccgtggtctcgttgttccttgggagggtctctcctaactgattgactgcccacctcgggggtctctcataatgagctagaggtaggctgacactaggtctataatgcctagatatggtcagagatggaatattctgcataaagaaataggcagtaccactagctgtatgcccaacacagaagagaacgcaggatccagcatggatctctcctcctcccccaactcatgtagtccaggatcctcttgaattc

SEQ ID NO: 2146 - DNA, 331 bp, Rattus norvegicus
  Genbank Accession No. X02284
ctgcctgaccactaatccattggagacacccacagtcatgtgtacagttgtcttgtatttttttgtttgtttgtttgtttttttagacctgtcatcatggctcaccgatttccagccctcacctcagagcagaagaaggagctctccgagattgcgcagcgcattgttgccaatgggaagggtatcttggctgcagatgagtctgtgggtgagtgtaagaaagtcatgccacacaaggcacaccgtgcttgcaccttggaaaaggcagttagacaatcagtctccttccacacagaggaagtaaaggtttatgtacttagtgagtgcaggc

SEQ ID NO: 2147 - DNA, 557 bp, Rattus norvegicus
  Genbank Accession No. X02291
ctgcagatccttaattcagtcttctcttacgcttggttttcaggccaactgtcaggcagcccaaggacagtatgttcacacgggctcgtcaggcgctgcttccacgcagtcactcttcacagcctcctacacctactagataccgtcacctaccagccagctccagttgtcctaaatattttggttggagacctcaaaggcttcagtcagccctgaaattagatcacatctgattgaacttttgaaaacaccacatactgcgaatcagctgttgaagtgcggagtatgagcacgtcacccagtagtctccgaacacctccagttccccgtgttccagaacatccatccaagagaaggaacgggctttacatggaaggtcagtcttccatgcatacagccactactgagcaaagcagctcggaagggaaggaggagaagggcattttaacaaacatacttaccgggggttggttagagaagaggcacagcagcagaaaaagaaataaaaagtctatgaaccttcagttggtactgtttcactgctctgctctgctcga

SEQ ID NO: 2148 - DNA, 735 bp, Rattus norvegicus
  Genbank Accession No. X02904
acgcagctttgagtccacacctctgtctacgcagcagctatgccgccgtacaccattgtgtacttcccagttcgagggcgctgtgaggccacgcgcatgctgctggctgaccagggccagagctggaaggaggaggtggttaccatagatgtctggcttcaaggctcgctcaagtccacttgtctgtatgggcagctccccaagtttgaagatggagacctcaccctttaccaatctaatgccatcttgaggcacctgggtcgctctttagggctttatgggaaagaccagaaggaggctgccttggtggatatggtgaatgatggggtggaggaccttcgatgcaaatatggtaccctcatctacactaactatgagaatggtaaggatgactatgtgaaggccctgcctgggcatctgaaaccttttgagaccctgctgtcccagaaccagggaggcaaagctttcattgtgggtaaccagatttcctttgcagattacaacttgctggacctgctgctggtccaccaagtcctggcccctggctgcctggacaacttccccctgctctctgcctatgtggctcgcctcagtgcccgccccaagatcaaggcctttctgtcctcccctgaccatttgaaccgtcccatcaacggcaatggtaaacagtagtggacgaagggacaggaactccttgtcccccttttcccagactaataaagtttgtaaggcaga

SEQ ID NO: 2149 - DNA, 3237 bp, Rattus norvegicus
  Genbank Accession No. X04979
cggggatggggagagttcacccgtggcagaggaatcaacaaagaggggccagggctaaaactcagttttcaccccagaagctgagcctcttaacagatagagccccccacctatttccatttaagcctccagcccttttccgtacaacgaatgcaccagaccccgcgggaaaggggagaagcagtactcagtgccccagcaccaaggcctggattattcaatgaggagtcagctcctttttggggggggggggtcacaaggcatcaaaactccacctctttcctctgccctgctgtgaagggggggggagagcaacccgcctcgtgacagggggttggcccagcccgccctagccctgaggagggggcgggcaggggggagtcctataattggacaggtctgggatccggtcccctgctcagaccccggaggctaaggagttgtttcggaaggagctggtaagacaagcttgggctggcgattcacccagggggcttggtaagacgtgggcaggggaccttgaaatccgctggagtccaggaaacaggcacaattattagaaaagcaggaagcccgatagaagacttagggtggcggggagacaaactaagatcgtgaggtaactagcctttgccggggtcagaacagatggaggagatggaggggtcatctccaggagtactgtcggtgcacggcatacgggctcaactagaaggtagtatcaatctttagcgaaggacccgcgatgagccttaggttgcgtttatgtaaatacctactgatttccatcacagtccccaaaattaccctggccagtttcaaagcgaagaccctcatgcctgagcgtccgaagttctggggtcgcgggagggtaccacttcgcagggatggaggacgattaaaagcttacattagtactaaaccgagagcccggcttagcagggaaggtagaaaggaatgtaaattggaccaccggctgtccctctgcgttgtggaatttgaaccctaggactgggagctggaatttttggcagcgggtccaccccggggtgctgagatagagataggagggggaggtaaatagacctttgggcagatgctctattgtggagatgtttgtgatgactcacagacctgagaagggaattaaggtgggggctctttgggtggcccgagtttctccacccctacccactggtgttcaaagacagcttttccttccgcagactggccaatcacaactgggaagatgaaggctctgtgggccctgctgttggtcccattgctgacaggtatggggcaaggggtggctttccctgctggcaggttggggttggggcagttctgagacctctgagattcaatagccctgagcagctgttttacatgcaggccttgtctttccctatccataatatgagaggattgatgctcagagggtaaaggtgcttgtcataaagctcgaagacttatctcggagcccaacatggtggaaggagagagcggattctctctagttgtcctctgacctccaagggtacacacacagacacacaattaaaaagttgaagtgtgtaatttcttagtcgcttttaaaggggaggtatacattttctaaccccataccagcctagtctcagctctgttctacataggatactagacagtgtatgcttgtagtatctaaacagactccacgactgacttccagacgcactgttgcttcaaagagacccaagagcactgtaggtcctgacccagccttaaacttactactctacacaggatgcctggccgagggagagctggaggtgacagatcagctcccagggcaaagcgaccaaccctgggagcaggccctgaaccgcttctgggattacctgcgctgggtgcagacgctttctgaccaggtccaggaagagctgcagagctcccaagtcacacaggaactgacgtgagtgctcagcgcttcaccctccgcacctgctgagtatccagatccaggggttcctcctatctgggcacctacctacttcttgtttcctttctccatgagtgtgtgggccaggttggcttgaactctcaatacttctgctttctttagccttctggatactgggatgaacaggcattcatttatgttcttggtcgaatggcttttggctttttgagacaggatcccaatctaacttaagctggcttcgaaggctctgcaattctccttcctcagcttctcaacttctgggaatacaagcgagtaccaccgcacctcgctctgtggtttcctcccaccctaattctgacctttttgtctctgcattcatctccctcttgtgtttcctctgggcctgcagggtactgatggaggacactatgactgaagtaaaggcatacaaaaaggagctggaggaacagctgggcccagtggcggaggagacacgggccaggctgactaaagaggtgcaggcggcacaggcccgtctgggagctgacatggaggatctacgcaaccgactcgggcagtaccgcaacgaggtaaacaccatgctgggccagagcacagaggagctgcggtcgcgcctctccacacacctgcgcaagatgcgcaagcgcctgatgcgggatgcggatgatctgcagaagcgcctagcggtgtacaaggccggggcacaggagggcgccgagcgcggtgtgagtgctatccgtgagcgcctggggccactggtggagcagggtcgtcagcgcacagccaacctgcgctggcgccgcccagccccgcgcgatcgcgcccaggctttgagtgaccgcatccgagggcggctggaggaagtgggcaaccaggcccgagaccgcctagaggaggtgcgtgagcagatggaggaggtgcgctccaagatggaggagcagacccagcagatacgcctgcaggccgagatcttccaggcccgcatcaagggctggttcgagccgctagtggaagacatgcagcgccagtgggcaaacctaatggagaagatacaggcctctgtggctaccaactccattgcctccaccacagtgcccctggagaatcaatgatcatccctcacctacgccctgccgcaacatccatgaccagctaggtggccctgtcccaagcaccactctggccctctggtggcccttgcttaataaagattctccaagcacgttctgagtctctgtgagtgattccacacagcttcagcctcagtttat

SEQ ID NO: 2150 - DNA, 13011 bp, Rattus norvegicus
  Genbank Accession No. X05684
gaattccagggcatcagccaaggataaccccagtgagctcattaccccaaaaagttgggcatcagggtagttccaagaatctggatagagagtgtcctctggtaggagcatgtgctcagcttactcctcacccagtctcccacgggtgctattccccactgaccaaactctgtggaagccctgggacaaagcctttggctccttgccccaaatcagagaagaaggggccagagacagggtctggagtgaccccagatgcatggcacactctcctcaactccctggggcctcctgtcaggacaggaaagcaaaagcatgcccagctgtcagtcctggattttaatgattaactggcacttcaaacacagcctgtgccaaacaggagtcttggattccaccatcttttttctttctttcttttctttctttcttttttttttttgatatttttatttacatttcaaatgttattcccttccccggtttccctttctatgaggatgttccccctccccaaccaccccccattcctgcctctctctctctctctctctctctctcacacacacacacacacacacacacacacacacacacacactcctctgtactgggggtggggtgtgggtgtccagccttggcaggaccaagggcttcccattggtgcccaacaaagctgtcctctgctacatatgcagctgaagccatgggtctgtccatgtgtactctttgggtagtggtttagtccctggagctctggttggttggcattgttgttcatatggggtctcaagccccttcagctccttcaatcctttctctaaagggttccaccatcttaaccctacttccacacttacctcagtgaacaacagacacttctcccctcccgcctgcttgggttatatcagggccccttgaaaagccctctgtgccttttctccctacagctcctccctaattctttggctcaagagaaggcccaccttgacctggttggcctttgtgactattgtgggaggtcagaatccactggagacctcacccagtccgaagccttatgtctcacctccccaggaaagccctttgctcccctatcccaggaatacagggtgttagctatcacatcttcaaaggttggcttcagagaaagatgacttcctcctgcttgcagtacctcagcactggcagatggatgggacatttgaccccagagcaaaaccagacttctccatgttgtactccaagcactgaaagcctcccttaccagtacagctcctcattccactctgccttcccttttccaaaacacatctcacagacttctccctccccacagtgccacccaggctagcctgtcacctcccaccctgagcaactcccaagactcacctgtgtctccctaatccaccactgactccaccactgactccagccagagcaaccgtaaactttacttgaattatgtccctggcagcaatgccagttgccgctcagtgcccagctttaccatggccacgttctccctcccagcttcttctacacggaaaggtttttcttcctcagagttgtgggatatatttaacctgcagaggaatgtgtgtgtgtgtgtgtgtgtgtgtgtgtgtgtgtgtgtgtgtgtgtgtttcctctgcccctgctggtcccctctcatctttaatagtgtaggcagaatcacatcaaagagagccgcatcttcattaggaggtacctaagacacatcactgcaacgcccggcccctctacccagtaccgagatccatccctgacagcccctgccctgtttatagcatttatttatttgctagtagtctgtcccccacccctgctatactataatccacagacgggaaagtttccatctgcctgactcccactgtatcctcaaggtctgtcactggccggtgtcatagtgagaatgccacggaaggcctcccagagaacccccctgttttatcaactttgcggaacatgcaaaaccacctaagactggagtcaggaggatccccagagtagggccttctgggattcaagagagcagtaagtgccaggtggtccccttggtagtgataggggattctgcctgcaggactgcagtttaccatcatggtggtcaacaaggcaaggtcattctccctggtgctatggtatgatctccctggtgagatcgatgcccttgtgatggctgaggagatcccctgtactcaggtttccatgtgtttatccatacggctggtcaacaacaatacaagtttatgagttagtgcctaggaatgttcatggtttcatctctgggttctcagaggaacatgtgcgagaaactgagagaccctctaacctttaactaccaaagggtatccctgttttccacagcctagtccccaccttcaagctcttgttctgagaatacacctaagattctcttcaataaaatgcaaagagaaaggcattgtactgttggcaatcaaccaatctcttctctaatgatgagccaacaatgtgaatggactaatgattgatcaggaaaaaatagatgacctaggggaaggggagagatgggggccccacaacaggcagtccttgagaagggactctgtggggatggggctgcctgctgggtgtgccccttttctattctctggcttcctcagataagaccagcagttagggtacactctcctcccagtctgccgttcttgcagacacagttccacgctttggaagcatgtctgtccaggagaacactctaccccagcagctctggccgtggatctttaggtcccaaaaagacttggcaaagtctgccttaagtggggctcccggaggtaagaagaggaagggaagccactgaagagagaggagaattagggtagaatcagcgttgagagatggaggccttgtggggtaggatgcccaatatagcctcacctcggctaaatacagacctgatctgagcctttgatccaggctctgcagacaggccaaaggggatccagcagcatgggcgcacggggcactcccgtggttcctggactctggcccccagtgtacaaggcttccgttggcaagagagatgctagctggttatactttaaccaggactcatctcatctgagccaggccccatcccactgacaaaggcgcagtataaagcagacccacagacacagcaggtaagcaacgtagcagcatggaaggtgcttctaaaccgggtgctctactgagcagggctgggtcaagctacggatccagcgcagccttgaatgggtggagggaaggtggaggggaggggagtggagaaggccagagaattgcctggagctggaagaagtaaacaagaaaatgagggaaagtaagctgagtgtttgcaggcctagataatgaggtgcaggcttgaaggaggcctctgggagggctgaagctgagtggtctgcagcggtgtgacgcttggggaaggtctctgtagcttggggatagacctggatttgaatcatctcacttggctgatgcattttttttttcttagacaatgtatttttttttccccttggtctttttcttacttgtaaagtggggatagagcaggaccctggagactaaacaaagtagcgggtgtgtgatagtcaaatgggaggaagacctcgcaccatctggagatctgaatagacacagggtgcactggcaggaagcacatgggggacaggcaggtgtctgtgcaagagcctgagtttccatctacggcagggccagcgggataccttcgacgtgcgagtgtggctcaactgacccaggagctgggcactgccttcttccagcagcagcaactgccggcagctatggcggacaccttcctggaacacctctgccttctggatatcgactcacagcctgtggctgctcgtagcaccagcatcattgccaccattggtaagaccacccaagccctagaagccacacagggccacccacatggctcaggtgtctccttactttgctatccttgttgtggtcattcattcaacaaatatttgtgagatttgtgcaggggtagggggtgggtttgtttttgtttttgtttttgtttttttgagatcgggtctttttatgttgtagctctgactgatggataggcaggtctcaaatttagaaatctccctacctttgcctcctgagagttggactgggaccaccttgctccacatgaggctgggtttttgagacagggtctcaggtagccttggatatttctagcttatttcatagaccctattatatcgtcttagcctggtgaaagcataggtatgtgataccacacccaacttaacaaatgcttgttgagtacctggaaaacaaggtttggaattggggggtagactctatctcaaaaacaaataagaacgaggaaaggtgtcatctgcacacagatggccttccaaggataaggacggctgggatcacagagaagtgaaaggtatatataatgaactgaggaccagacagacacacacctaatacacacatgtcacacaacatacacacacaccacacacatacacatgcaccacacacatacacacacacaccacacatatactacatacccacacacacaccactcacatatcacacacatgtaccacacatacacacatcttgcacacacacacacaccacacacatatcactcacacatcacatacatataccacatatacacacagcacacacatacaccgtatatgcaccatatcacatacacacacaccattcacacgtcacacacacacatgcactatacacacacaccacacataacactactcacacatgacacacatatactacacatacacaaatcactcacacataccattcatacacatacatcatacacacataccacacaccactcacatatacaccacacacacaaacatgtacaggccacacacacacacacacacacacacacacacacacacacacacacaccagtcctcacacattatggctcagcatgctcagcagataaagtcttgtcatggagctgggtgacctgagttcaatccctgaaaccacatggaggattcggccacacacaccaaaaacaaaaacagaactcagtccagccaggctatgaggccctgtttcaaggagagagggtgggcagtagctctgttgttagaacacttgcctcctgcatgaagccctgggtccgtcctagcgctacataaattggctgtcgtagagtacacccttaacccagcacaggggaggacaggagaaccaagcccaaggttatccccagaagccagagcaaacccaaggctagcctgggttatgggagtccttgtctcagaaggaaggactgttattcctaaagaatgggagataaggatgggtgtagctcagtactatagcatttatttgcctcgcatgtagaaggccctggcctccatctccagagcagaaaaaaaaaatggtggccagggaagaagagggagggggaagtgcatacagcgagctgctgctgctgctgcaggctgacgtggatgaagacagggacagatctcagttctgtcagtgagattgctcagctttcaaagtgcctttttgacctgcctggcgttctgacccttcacagcctacagtaacctccacagcatacacttatgtcaggtcacttgctaacaaaggtcctgaggcctgactgagatttagacattccacaagctgccttcccaagggctgtgtactggttggagtgggggaaaaaaagagtttgtgagtagaggaacttcgaaggactcctgggtaggggagtctctccgatgttgcagatgggtttgactgtcaggcttgggaggaccttcttagtgggttctctggttccagggccagcatcccgctctgtggaccgcctcaaggagatgatcaaagcagggatgaacattgcacgactcaacttctcccatggctcccatgaggtgtggggaagaagtcatggagggtggagctgagaatgcccccaaggtcctgttcactttgccttaagatccaggttttgttctctctctctctctctctctctctctctctctctctctctctctcgctttctctctggtagtaccatgcagaatccatcgccaacatccgggaggcaactgagagttttgcaacctccccactcagctacagacctgtggccatcgccctggacaccaagggacctgagatacgaaccggagtcttgcagggggtgagaagcctttgggtccgagctgtctggggcctggaggagcatgagagccctggagcaagagagagggtccctaccctctcagggtccacttgcaaaactcaggcttctctacccaccccactcccctccagggtccggagtcggaggtggaaattgtgaagggctcacaggtgctggtgacggtggacccgaagttccagacaaggggtgatgcaaagacagtgtgggtggactaccacaatatcacccgggtcgttgcagtggggggccgcatctacattgacgacgggctcatctccttagtggtacagaaaatcggtacagaaatgcatcctgatcttatgaggcgctcccaaaaccctgaaacagggcattttctcttccctttggtttctatgttctgtcagctccttacccataccttcccctagtggtgcttgcttctccacctgtcctagtggtccctgctgtcatcatgggttggagctgagcatttgatgcctcttcttgtgtgtggagtgagtgaagggttcagaagattccaatttctggaggatccaagcttaagagttccctctgcagtgcctatatcgcagctcagccttacagacactggttctctctatacccgcaggcccagagggactggtgacagaagtggagcacggtggtatcttgggcagcaggaagggtgtgaacttgccaaacactgaggtggacctgcccgggctgtctgagcaagaccttttggatctgcgcttcggggtgcagcataatgtggacatcatctttgcctcctttgtgcggaaagccagtgacgtgttagcagtccgggatgccctggggccagaaggacagaacatcaaaattatcagcaaaatcgagaaccatgaaggcgtgaagaagtgaggcttagtctttggtccgtcagccctctgtttctctttccctctcttctgcatgatatttcctgccatctcctcctctgcctagcctggattcctccaaccaccaggtttgatgaaattctagaagtgagcgatggcatcatggtggcacggggtgacctgggcattgagatccctgcggagaaggttttcttggctcagaagatgatgattggacgctgcaacctggccggcaagcctgtcgtttgtgccacacaggtctggagcaaacccttgggctttaaaggtgctgagaaacctacatgttgctgtctggtgcctggtcacaaaagacgatgacatgaacttccagggtcttactgtgaccctggcactctaagcgtgcaggtgccagagaaatagcgtgggcgggttcgggtccccagtcagaatgtgacttctacagctttgacatccatggtgtcactcagatgctggagagcatgatcactaaggctcgaccaactcgggcggagacaagcgatgtggccaatgccgtgctggatggggctgactgtatcatgctgtccggagagaccgccaagggcagttttcctgtggaagctgtaatgatgcaacatgcggtaggtactccgttctgaaaagctgctgggccagcgacacagacccctctggaaccccgttgactactcaacctgacctactggtccctgcagattgcgcgggaggcagaggccgctgtgtaccaccgccagttgtttgaggagctacgccgggcagcgccgctgagccgtgacccaactgaggtcactgcgattggagccgtggaggcttccttcaagtgctgtgcagcagccatcatcgtgctgacgaagactggccggtgagaaacatattggaaacagggctttgggcaggggcggctgacacagaggctaataaaaaaagcactgctttagggcaagcaaagaaacagccatggatgctagaggccaggagaggctagaggcttggacaggtggctttttgatgatctagaatcagagccagtgatgggggggggggggcgcacggggacggggacgcagcaggtgataacccaagcacgttggccttagggtatttgaagaccaggctctgacagatcttcactgtgctgaggtgttgctgaaaaacccagtaggcccaagagctgaggatttttctcaaacttagtagtgagatcctaagtaattgttagggcttacaagccttgactccatggatctgtgtgagtttttcatttgtccccaccccaccccacccccatggggttgtgaggattaacaaaaaatggttaagagtcatatggaggttgggaatgatgtaaacatatcttctagacagttttaccctttttttgttgtttgtttggtaggatttttctgacatagggacttattagtcctggctggcctgaaacttccttagtacctgaagtagccttgaacttaaccctttaccccgagggctgaggttgtgggcgtgtctcaccacgcctggctggctttacatttctaattttttggaggatttattacttttatgtgtgcatgtacagttctaaggcgagaagaggttggaccctctggagctggagttacaggcagttgtaagggatttgatgtgggtgctcagaaccaactctggtcctcagaaagagcagtgcgagcctttaagaactgagccatctctctagcccaggttttacatttatctttcaatatggattgacattttgcctgcccttacgtctgagcaccatttgcatgtctggtgccagtgaaggccagaagaggatgttagagcccctgaaactggacttaaaaaccattgttagccaccatgctggtgttgaaaacgtaatcccagcgtgtgctcttaatggtgagccgtctctacatcagggtaggtcttcttactacttaatgagaaagacaaagatcagaggagtataccttacccaaggacacagggtttgttagtgacagtgacacctggaaccataattcaaactcgtttcttgggtcaacactcagagctaaccttttcttcctcatgcagttcagcccagcttctatctcaataccgacctcgggcggctgtcattgctgtgactcgatctgcccaggctgcccgacaggtccacctgtcccgaggagtcttccccttgctctaccgtgagcctccagaggccatctgggcagatgatgtggatcgaagggtccaatttggcattgaaagtggtgagccttgccctctgttccacagcctgccttcttaccccgactccaaagctctgtctgtcctcactggcccaagttttctaggaatcgctaagatggacatgtcttgggctttatttttgtttttttgtttgtttgttttttgttttttttttaaagatttattcatttattatatataagtacactgtagctgtcttcagacacaccagaagagggcatcagattctgttacagatggttgtgagccaccatgtggttgctgggatttgaactcaggacctctggaagaacagtcagtgctcttatccgctgagccatctctccagcccatgtcttgagctttaaagcaggaagggtaggctgagaggaaaggagtgagagcaggacccctgagaagtccttgctgctgtctgccacagcctagtaggacacatcagtaagaggaggttccagaagagctggaactaaattttaatttatagttgtccttgtcccattagtgcagccacatgggtgaaaaggctcaatgctgaaaaacagtatacagcatccctccacacacacatcctctcaaaccactgcctttggttcctttcccctacaggataggtagccttgaggtggtcgatgctaatggctgacccaggttcttcaatgactgtcatatttttctccaccaggaaagctccgtggtttcctccgtgtgggtgatctggtgattgtggtgacaggttggcggcctggctctggctataccaacatcatgcgggtgctgagcgtatcctgaaatgcctctccccattctgacccagttacaccctatttctttcaacccacacccctcccatagtcctacatctgccatctagccccatccctgtgctttacacagccctgaatgtctgtgtccaattatacagtggccaccggcagcatcggttgtatatccctgtctcaatccgctcagctggactctaagataccctgagcctttaatcccagcccagctggtgattcgattccttccgggtcccaatcattggaatgggggagtggaaacagggtgatcttgtccaattttcatacaatcatgattttaaaacactgtctgatataaccctcatgatcagttcctagcaaagtgtcatctcctaatggcctcaagtcagggcagaatactccttcaaggagcacagctccacactttagggaaggctggggcagctgggtactggagagaactaagacaggcggcttttctctctctctctctctctttttttttttcttttctttttctttttttcggagctggggaccgaacccagggccttgtgcttgctaggcaagcgctctaccactgagctaaatcccaaccccagcttttctctttttaatacaagctctcactggcctcaaactcctaagtcctcctgcctggccctcctaagggtagggactacaggcatgagtgaccagctggacttcgggtgccttattttcttactgactccacaaaccatggttgttctcctgcccactgctctgctgggtcagatgatccagaaattcttccacaaccacttggctcccacatacaaattagaagcaaactgaatcttttcttttaaacccaactgtttaggtgcaattataaaaacaactcccacaggcaaagaatcccagaatctcctaccctaggagatgtatagtcctggccccacccatcaatctgtagtatactcctgaagcgggacagaactggtggacaggggactcctcttgtccctaagaaagtggaggcactgttggcccacccctcctaggtttgaatactccaggccctcctcttagcaccaacagcaaatccagatgaggaaaaaaaaataagtgcagttctcctgctgccctcctcttttcactacctcaatacagcaagtttgagtattgctgctgatggcagtgtgcaaggccacaaagatgtcccccctcagccccctaccagaaggtggagaggacagaggaatgaataataaagtgaatgcgtcaaattagcaaatgaataaataaaattaataagtgactgaataagacacagggaaagataaaaggtcacatgaggattcagccccttaccccctacctgggggagctaggctagcacagtaaggaggcgccaagtatcccttagctttagggcaacaccattgagtcagggagcacagtgaagagcagcttctagtttacaaaggtagtgctttccacacaggagctgcggagggcagactacagtgggcagagatacccgttctcacgtggtgtagacaaggacggtccgtccacacgtggcagtgagagggaagatggtcacacctagggccctagacatctgttggctgtactagataattgacagtacccagctacgacaatggggatgggaagaaaggacacactgggcacaacctgcagggtcactgacagggagacagccatctagtcactcggcagtgaaggaagcagcaagtacttgtgcttaataaaggcagggctgtgggcccaagcctgcacctggcaggactgtggcctggggacaccttgttaaagggctttgagtcacttctacttggcagtggctacacattgtacttagcacaatgccttgacggggtaggcactggtacctatgacaaatgggtatgtgattaggattcgcaggctgcagctgctatgagctgaggacacagaggacaactttgtggtagtaaagggcagtgtgttagatccccgcagccttccccaggggcgtctaccctcaggcacaccttattgcgtgccaatagctaaggccagtgcaatctaggatttcacatgttggcagaaatttggggacctctgggggtaactggctcaggcactgatgacctggatggctggacagtccctggaggcttggccaggagccccaagggcagcacgctcacttccagagcctttgcgcctaggagagccatcccccgtggctcgctgaggcagagagggttgagaggcagagagtgggcggcccctaggtcctagcctccgaccacctcctcctggggagggcccaacagagacacctgggaacgccctgtccgggataggctggcatggagggttcgggcaggtggagggggagggcccaacagagacaccttgggaacccctgtccgggataggctggcatggagggttcgggcaggtggagcaggcaggcgagaagtggacgcccagggtccccgggccagcagaggacctgctcggacaggcaccagtggggaggctggggagcctgctgagcgtctagcagatcgagccaggagggtggctggagaatcaggggagaggggcagagggcctcgctgatgagtcaaggctatggccacgttggaggtcacagcagctgcctgcagaggtgcgtgtaccagtggttcccacagcactggctttccactgaggcgagctcctgtgcccggagccagaccccgaa

SEQ ID NO: 2151 - DNA, 2116 bp, Rattus norvegicus
  Genbank Accession No. X06769
cgcaactgagaagactggatagagccggcggagccgcgaacgagcagtgaccgcgctcccacccagctctgctctgcagctcccaccagtgtctacccctggacccctcgccgagctttgcccaaaccacgaccatgatgttctcgggtttcaacgcggactacgaggcgtcatcctcccgctgcagtagcgcctccccggccggggacagcctttcctactaccattccccagccgactccttctccagcatgggctcccctgtcaacacacaggacttttgcgcagatctgtccgtctctagtgccaactttatccccacggtgacagccatctccaccagcccagacctgcagtggctggtgcagcccactctggtctcctccgtggccccatcgcagaccagagcgccccatccttacggactccccaccccgtcgaccggggcttacgccagagcgggagtggtgaagaccatgtcaggcggcagagcgcagagcatcggcagaaggggcaaagtagagcagctatctcctgaagaggaagagaaacggagaatccgaagggaaaggaataagatggctgcagccaagtgccggaatcggaggagggagctgacagatacgctccaagcggagacagatcaacttgaagacgagaagtctgcgttgcagaccgagattgccaatctactgaaagagaaggaaaaactggagtttattttggcagcccaccgacctgcctgcaagatccccaatgacctgggcttcccagaggagatgtctgtgacctccctggacttgactgggggtctgcctgaggctaccaccccagagtctgaggaggccttcaccctgcctcttctcaatgaccctgagcccaagccatccttggagccggtcaagaacattagcaacatggagctgaaggctgaaccctttgatgacttcttgtttccggcatcatctaggcccagtggctcggagactgcccgctctgtgccagatgtggacctgtctggttccttctatgcagcagactgggagcctctgcacagcagttccctggggatggggcccatggtcacagagctggagcccctgtgcactcccgttgtcacctgcactcccagctgcactacctatacgtcttcctttgtcttcacctaccccgaggctgactccttccctagctgcgcagctgcccaccgaaagggcagcagcagcaacgagccctcctctgactcactgagctcgcccacactgctagccctgtgagcagtcagagaaggcagggcagccggcactgactgagctggtgcattacagagaggagaaacacgtcttccctcgaggggttcccgtagacctagggaggaccttatctgtgcgtgaaacacaccaagctgtggacctcaaggacttgaaagcatccacatctggactccagtcctcacctcttccggagatgtagcaaaaaaacaaaaaaacaaaacaaaaaaaaaacaaaacaaaaaatcaaaagcaaccgcatggagtgtattgtttgtagtgacacctgagagctggtagttagtagcatgtgagccaggcctgggtctgtgtctcttttctctttctccttagtcttctcatagcattaactaatctgttgggttcattattggaattaacctggtgctggatatttttcggattgtatctagtgcagctgattttaacaatacctactgtgttcctggcaatagtgtgttccaatttagaaatgaccaatattaaactaagaaaagatagaactttattttccggtagatagaaataaatcgctatatccacgtactgtagctcttcagcgtccatgttcattgtcatgtaactgatcatgcattgttgaggtggtctgaatgttctgacattaacagttttccatgaaaacgttttattgtgttttcaatttatttattaagatggattctcagatatttatatttttattttatttttttctatcctgaggtctttcgacatgtggaaagtgaatttgaatgaaaaaattttaagcattgtttgcttattgttccaagacattgtcaataaaagcatttaagttgaatgcg

SEQ ID NO: 2152 - DNA, 3037 bp, Rattus norvegicus
  Genbank Accession No. X13722
ttgacccagtgcggcgtaggattgcagcccgcatacctggggcttgccacccaggttttgcagctgagacaccgtgggacccgtgatcctgtgtttgcagcgggaacatttcgggtctgtgatccgagtggggacgcgacgcagaggctgaggatgagcaccgcggatctgatgctacgctgggccatcgccctgctcctggctgctgctggagttgcagcagaagattcatgtggcaagaacgagttccagtgtagagacggaaaatgcatcgtcagcaagtgggtgtgtgacggcagccgcgagtgcccggatggctccgatgagtcccctgagacatgcatgtctgtcacctgtcgatccggtgagttcagctgtggaggccgcgtcagccgatgcattcctgactcctggagatgtgatgggcggaccgactgtgaaaatggctcggatgaactagactgctcccccaagacgtgctccctggatgagttccgctgccaggatggcaagtgcatctcccggcagtttgtgtgtgaccaagactgggattgcctggatggctctgacgaggcccactgtgcggccaccacttgtggccctgctcacttccgctgcaactcctcttcctgcatccccagcctgtgggcctgcgacggggaccgggactgtgacgatggctccgatgagtggccgcagaactgcggggccgaagacacggccgctgaggtggtcagcagcccctgctcctccctcgagttccactgtggcagtagtgagtgtatccatcgcagctgggtctgtgacggtgcggctgactgcaaggacaagtcggacgaggagaactgcgcggtgaccacctgccgacctgacgaattccagtgtgcagatggctcctgtattcacggtagccgccagtgtgaccgtgaacatgactgcaaagacatgagcgacgagcttggctgcatcaatgtgacccagtgcgatggccctaacaaattcaagtgccacagtggggagtgcatcagcttggacaaggtgtgcaactccgcccgggactgtcgtgactggtcggatgagcccatcaaggagtgcaagaccaacgagtgcttggacaacaatggtggctgttcccacatctgcaaggacctcaagattggctatgagtgcctatgtcccagcggtttccggttggtggacggccaccagtgtgaagatattgacgagtgtcaggagccagacacctgcagccagctctgtgtgaacctggagggcagcttcaagtgcgagtgtcgggccggcttccacatggaccctcacaccagggtctgcaaggctgtgggttccatagggtttctgctcttcaccaaccgccatgaggtacgtaagatgaccctggaccgcagcgagtataccagcctgatccccaacctgaagaatgtggtggcgctggacactgaggtggccaacaatagaatttactggtctgacctgtcccagagaaagatctacagcgccgtgatggaccagggcaccagcttgtcctatgatgccatcatcagtggggacctgcacgcccctgacgggctggcggtagactggatccatggcaacatctactggacggattcagttccgggcactgtttccgtggctgacaccaagggtgtcaggaggagaactctgttccgagagaaagggtccagacccagagccatcgtagtggaccctgtgcatggcttcatgtactggacagattgggggacacctgccaagatcaagaaagggggtttgaatggtgtagacatctactctctggtgaccgaggacatccagtggccaaatggcatcacactagatcttcccagtggccgcctctattgggttgattccaaactccactccatctccagcatcgatgtcaatgggggtggtcggaaaaccattttggaggatgagaagcagctagctcaccccttctccttggccatctatgaggacaaagtgtattggacagatgtcttaaatgaagccattttcagtgccaaccgcctcacgggttcagatgtgaatttggtggctaaaaacctcatgtccccggaggacattgtcctgtttcacaacgtcacgcagcctagaggggtaaactggtgtgaggcaacggttctccccaacggtggctgccagtacatgtgcctgcctgcccctcagatcagtgcccactcacccaagttcacctgcgcttgccctgatggtatgctactggccaaggacatgaggagctgcctcccagaagtcgacactgtaccgaccacccaggggacatccaccattgggcctgtggtcaccacatcagctgctgtgtcactgaagcgcaaggaggatccctcagctactaggcacaaggaggatccctcagctactaggcacaatgaggatccctcagctaccagcacctctaggcagcctggggataccccagagctcagcacagtggagtcggtgacagtgtcctcccaagtccaaggtgacatggctggcagaggggacgaggtgcagcggcacggtgtggggttcttgtccatcttcctccccattgcactggtggccctccttgtcttcggagccatcctcctgtggaggaactggcggctgaggaacattaacagcataaactttgacaacccagtctaccagaagaccacggaggacgagatccacatttgccgcagccaggatggctatacctacccctcgagacagatggtcagcctggaggatgatgtggcatgaacagctgaggggagccatctctttccgggatccgctgccacccttaggcaggaaggacgctttctcacacctccccgccctgcactggtccttccacctcagtggtctctgtgttgctcaaagcaagataagagcaaaactgggctggggccaagctcagcggcctgtctgccctgggtcctgttttatatatttattgtctggggacagaaaaggctactggccatgctccagatgggaattc

SEQ ID NO: 2153 - DNA, 591 bp, Rattus norvegicus
  Genbank Accession No. X14181
cttttgtgagtggcagtgaacgagcacgcactgctatgaaggcgtcgggcacgcttcgggagtacaaggtggtggggcgttgcttgccaaccccaaaatgccacacaccgccactgtaccgaatgcgaatctttgcacccaaccatgtggtggccaagtcccgcttctggtactttgtgtcgcagctgaagaagatgaagaagtcatccggggaaattgtgtactgtgggcaggtgtttgagaagtcacccctgcgtgtgaagaacttcggcatctggctgcgctatgattcccgaagtggcactcacaacatgtaccgagagtaccgggacctgaccactgccggcgcggtcacacagtgctaccgagacatgggtgcccgacaccgtgcccgtgcgcactccatccagatcatgaaggtggaagagattgcagctggcaagtgccgccggccagctgtcaagcagttccacgactccaagatcaagttcccattgccccaccgtgtgttgcggcgccagcacaaaccacgcttcaccaccaagaggccaaacaccttcttctagacaccagagacccactgaataaaag

SEQ ID NO: 2154 - DNA, 508 bp, Rattus norvegicus
  Genbank Accession No. X14671
tccttttgcggccatcgctggattgcagccgccaaaatgaagttcaatcccttcgtgacttctgaccgaagcaagaaccgcaaacggcatttcaatgcaccatctcacattcggaggaagatcatgtcttctccgctttccaaagaactgagacagaagtataatgttcggtctatgcccattcgaaaggacgacgaagttcaggttgttcgaggacactacaaaggccagcagattggcaaagtggtccaagtgtacaggaagaaatacgtcatctacattgagcgagtccagcgagagaaggctaacggcacaactgtccatgtgggcatccgccccagcaaggtggttatcaccaggctaaagctggacaaggaccgcaagaagatcctggagaggaaagccaagtcccggcaagtaggaaaggagaagggcaaatacaaggaagaaactatcgagaagatgcaggagtagaaaaataatgcccagttttcattaaataaagctt

SEQ ID NO: 2155 - DNA, 851 bp, Rattus norvegicus
  Genbank Accession No. X15013
cgagcggatgcccaaaggaaagaaggccaaggggaagaaggtggccccggcccccgccgtggtcaagaaacaagaggccaaaaaggtggtcaatcctttgtttgagaaaaggcctaagaacttcggcattgggcaggacatccagcccaaaagagatctcacgcgcttcgtcaaatggccccgctacatcaggctgcagcggcaaagagccatcctctataagcggctcaaagtacctcctgccatcaaccagttcacccaggccctggacaggcaaacagcgactcagctgcttaagcttgcccacaagtacaggccagagacaaagcaggagaagaagcagaggctgctggcccgcgctgagaagaaagctgctggcaaaggggacgtcccaactaagagaccacctgtcctccgagcaggggtcaatacagtcaccactttggtggagaacaagaaggctcagctggtggtgattgcccatgatgtagaccccattgagctggtggttttcctgcctgccctgtgtcgaaagatgggggtgccctactgcatcatcaagggaaaggccaggctggggcgcctggtccacaggaagacatgcaccactgttgccttcacacaggtgaactcggaagacaagggtgctctggctaagctggtggaagctattaggaccaattataatgacagatatgacgagatccgccgccactggggaggcaacgtcctgggtcctaagtctgtggctcgcattgccaagctggaaaaggcaaaggctaaagaactcgccactaagctgggttaaatgtacacttaagttttctgtacataaatataattacaaagtt

SEQ ID NO: 2156 - DNA, 544 bp, Rattus norvegicus
  Genbank Accession No. X17665
ctttccggtggcggcgcggcgcggtgaggagctcgtgttcatacttgtagctatgccgtccaagggtccgctgcagtccgttcaagtcttcggacgcaagaaaacagccacagctgtggcccactgcaaacgaggaaatgggctcatcaaggtgaatggacgtcccctggagatgatcgagccgcgcacgctgcagtacaagttactggagcctgttctgcttctgggcaaggagagatttgctggtgtggatatccgggtccgtgtgaagggtggtggtcatgtggcccaaatttatgctatccggcagtctatctcaaaagctctggtggcttattaccaaaaatatgtggatgaagcctctaagaaggagatcaaagatatcctcatccagtacgatcggaccctgcttgtagctgacccccgtcgctgcgaatccaagaagtttggcggtcccggtgcccgtgcccggtaccagaaatcctaccgataagccagtctcaaggatcagggtttacctttgtaataaacatcctgggacttt

SEQ ID NO: 2157 - DNA, 3330 bp, Rattus norvegicus
  Genbank Accession No. X51529
tgtgatggaatgaatgactgacacgtgaattaagcagcgtacagaaccagcgttccctttcctatcccccaaagtyacagtttatcagaagaaagaaacatcccagactttcaaacactcattccctcccctgtatacagtccttccatgctcctggaagtggctgccaggaggctgcaggcggtcacacccagatgggcttttggaaagttctccagtcaggagctgcaccctgtttctcatcaaccgaatgaactttcgaaatcagctaaagtttatgatggccacaacccatggtatgagggcttttccggccctcaaggctgttctgccagctgttggggggaaaaggggaaattacccagggcgttgggtatgcccgtctgtgaatccattatttggccacacccacctccccatccctgtggctctccgatccccagccctgcagagggaagagctatttaagagcattgggagtacaggaaaaacaaggcaggcccttgaacaagaagccataccaccatcccatccaagaggtacatgcccagaaactcctgccctttggatgcatttgagtgattgtgcatgtgagcatgtgtgtgtgtatggacgtgcctgtggatgtgaattcccatcaggtaaacatgtacaagaccgcattcctgggcaagtatcttatatgggattgtgagagtgctgggggagaatttgagaatgtgtgtgtttacatgtcatccgtcgtgggttagaaaggaggcatcatatgtataaatatgtaatcgtcacaggcttacaagggcagcatgtgtgcatgtcatttgcatagtgttagaatagaaaggcatcatgtatgtatacacgtagtgggcagagtcagaaaggcttgcaaagagaatgtgcagttttagttggagaggagactgtcaggatcggaccctgtggatggaattcctaagccttgaatctaacttgaggatgtaggtgaagtatatagtggaggcagacattgccttcaacccctccaccccaattctgcagaacgagtcccaggaggactagaggaagtgcaggggtggtcccatcaccacatcattcctgtgtgagggacagttccacggagccaggagggacaagaggtgacattcgaaatgcacggtcggaagccactctgtgtgtactctgtgacttagccccatgcaagtgcacatctgtgctctgggattgctaagtcagacagctgagcaggggctgggtaaagggtaagctgtcctggaaggaagtgaccaggctgtgtgtacctgtccttcacagagctgacagcatgaaggtcctcctgttgctagcagttgtgatcatggcctttggtaagagtggaccctgaactcagcacaatgagagaggtaacctgaggagggaggcaccctatcccctggctttccttcctgtgggcctggccctctcttagtgtgaggaggaagaagccatttgtggggagagaaagtagcagagagatgccatgtggagttggggcacagaggttcaccacccttgaccagcttatttccccatttcctttcaggctcaattcaggtccaggggagccttctggagtttgggcaaatgattctgtttaagacaggaaagagagctgatgttagctatggcttctacggttgccattgtggtgtgggtggcagaggatcccccaaggatgccacagattggtaagaccaccccagtccccctatcctctgtcactccagctggacgggactaagagggagctggtactcactacctcagtgtcccaccgaatcccagccagccgatgttagcagattgggagctctgccctggaccactctaaagttcttgagtctctgctcagaaccaaaggtcaaaggaagtgctggggtaccaggactcaagggccgtgagaaggcagcctcagtaaggtctgtcctccaaccaggtgctgtgtgactcatgactgttgttacaaccgtctggagaaacgtggatgtggcacaaagtttctgacctacaagttctcctaccgagggggccaaatctcctgctctagtaagataccctgagatacctgcccgctttcttcacgggggtgttgagcacacacatgcatgctgggaactttactggtgcaggcttacttacacaagcaggcctgttagcaggacagcagggccaaagatgtagctcagctggctgggtgctagcctagcatacgtgagggcctgggttccaccctcagcagtgtatgaaatgcacaaaatttggcatgacctgaatcccagtgctcatgtgcaggcaggaggatcagaagttcaaggccatcttcagctacttagagaactcaaaggcagcctaagctataaagaccctgtcccctcacccctcgtccctcgcccctcgctcctcccccttccccctctccctcccctcccccccaaaaaaaccctagaagagggtggctagggatcgaggcaaacctctggcagcgccatgtgtggccactgtgtgtccccatcagatggtcagatggggttctgccttcccaggaagcagacagttccccacgagcagccatgagacagtagccatcagctctgtgtccgtttccccctaattgcagcaaaccaggactcctgccggaaacagctgtgccagtgcgataaagctgccgctgaatgttttgcccggaacaagaaaagctacagtttaaagtaccagttctacctcaacaagttttgcaaagggaagacgcccagttgctgaaagagccatcttctgaaacatccagacatcctctaacacctctcctagcccaaccaagttccccagtgatcaagaaaacacccctctccaaccctagaagcaggcgggcccttctgtcttcacccagaaggagccgctgaagcctgatctttccccaacactccacagccttggatccgcccactttcacttttcccttggcatccaacttcctgctgcgtagtacctaagagagtcctgagaggctctcgcaagtaaagcaattcatcaacaaccacgtgtgtgttctcataactcgaaacgagacagatataaaatatgcatgctcaaagtataggccttgaggctggggaggtggctcagtccataaagtgcttgccaaaaaaaaaaaaaaacaaaaaaaacaaaaacacgagggcctatgttcaacccccagaacccagggacatcaagggcattcttgtttgcaatcctagagttggggaaagaaagaaagtggacccctggggctcaatggccagccaggctagc

SEQ ID NO: 2158 - DNA, 817 bp, Rattus norvegicus
  Genbank Accession No. X51536
agcggcgccgggcagaagatggcggtgcagatttccaagaagaggaagtttgtagctgatggcatcttcaaagctgaactgaatgagtttctcactcgggagctggctgaagatggctactctggagttgaagtccgagttacgccgaccagaacagaaatcattattttagccaccagaacacagaatgttcttggggagaagggtcgtcggatcagagagctgactgcagttgtccagaagcggtttggcttccctgaaggcagcgtagagctgtatgcagaaaaagtggccacaagaggtctgtgtgccattgcccaggcagagtctctacgctacaaactcttaggagggcttgcagttcgaagggcctgctatggtgtgcttcggttcattatggaaagtggggccaagggctgtgaggttgtggtctctgggaagctccgaggacagagggccaagtccatgaagtttgtggatggtctgatgattcacagcggagaccctgttaactactatgttgacactgctgtgcgccatgtgctcctcagacagggcgtgctgggcatcaaagtgaagatcatgctgccctgggacccaagtggtaagattggtcccaagaagcctctgcctgatcatgtgagcattgtggaacctaaagatgaaatcttgcccaccacccccatctcagaacagaagggtgggaagccagagccacccgccatgcctcagccagtgcctacagcataacagggtcttggcagctgcatctggaggctggatgttgtcttgtaaagacgtttaataaaatcttgaa

SEQ ID NO: 2159 - DNA, 671 bp, Rattus norvegicus
  Genbank Accession No. X51706
ccgagaatgaagaccattctcagcaatcagactgtcgacattccagaaaatgtcgacatcactctgaaggggcgcacagtcattgtgaagggccccagaggaactctgaggagggacttcaatcacatcaatgtagagctgagtcttcttggaaagaaaaagaaaaggctccgtgttgacaagtggtggggtaacaggaaggaactggccactgtcagaaccatctgcagtcatgttcagaacatgatcaagggtgtgacactgggcttccgttacaagatgaggtctgtgtatgctcacttccctatcaacgtcgttattcaggagaatgggtctctggttgaaatccgaaatttcttgggtgaaaaatacatccggagggttcggatgaggacaggtgttgcttgttctgtctctcaagcccagaaggatgagttaatccttgaaggaaatgatattgaacttgtttcaaattcagcggctctgattcagcaagccacaacagttaaaaacaaggatatcaggaagtttttggatggcatctatgtttctgagaagggaaccgtccagcagcctgacgaatgagacctcagtttcctagcttcagaaacaagatcctgataacaagtacagtttgggctctgtggaaacaataaaagacttatatattg

SEQ ID NO: 2160 - DNA, 509 bp, Rattus norvegicus
  Genbank Accession No. X51707
cctttcccctggctggcagcgcggaggccgcacgatgcctggagttactgtaaaagacgttaaccagcaggagttcgtcagagctctggcagccttcctcaaaaagtctgggaagctgaaagtccccgaatgggtggacacagtcaagttggccaaacataaagagcttgccccatatgatgagaactggttctacacacgagctgcttccacagcacggcacctgtacctccgtggtggtgcaggggttggttccatgaccaagatctacggaggacggcagagaaacggtgtcaggcccagccacttcagcagaggctctaagagtgtggcccgccgggtcctccaagccctggaggggctgaaaatggtggaaaaggaccaagatgggggccgcaagctaacacctcagggacagagagatctggacaggatcgccggacaggtggcagctgccaacaagaagcattagaacaaaggatgctgggttaataaattgcctcattcat

SEQ ID NO: 2161 - DNA, 3114 bp, Rattus norvegicus
  Genbank Accession No. X52711
caggagcttgcctgaccccagtggcaaggcttccagattcttctgaatcaaaccctttatgtccaaccgaatccacctggaaaacacgcaagagtgagttcctagaacgtcaaaatgaaggagcggacctctgcatgccgtcacgggacaccacagaaacatcctgatacctctgaagagagccaggcaatggagtctgtggataacctctgcagtcagtatgaggagaaggtgcggccctgcattgacctcatcgactccctgcgagctctgggtgtggagcaagacctggccctgcctgccatcgctgtcattggggaccagagttcagggaagagctctgtgctggaagcactgtctggagtggccctccccagaggcagtggtattgttaccaggtgtcctctggtgctgaaattgaagcaactgaagcagggagaaaaatggagcggcaaggtcatttataaggacaccgagattgagatctcacacccttcactggtagaaagggaaatcaataaagcccagaacttgattgctggggaagggttgaagattagctctgatctcattagcttggaggttagctctccacatgtcccagacctgactctgattgaccttcctggtatcacaagagtggctgtgggtgaccagcctgcagacatcgaacacaagatcaagagacttatcactgaatacatccagaaacaggagaccatcaacctggtggtggtccccagcaatgtggacattgccaccacagaggccctgaaaatggctcaggaggtggaccctcaaggggatagaaccatagggatcttgaccaagcccgatctggtggacagagggactgaagacaaggtcgtggatgtggtgcggaacctcgtgtgccacctgaagaagggctacatgatagtcaagtgcaggggtcagcaggacatccaggagcagctgagcctggctgaggctcttcagaaggagcaagtcttcttcaaggaacaccctcaattcagagttcttctcgaggatgggaaggccacagtgccctgcttggcaaagagactgaccatggagctcacctcccacatctgtaaatcgctgccaatattggaaaatcaaataaatgtgaatcatcagattgcgagtgaggagctgcagaagtacggagcagacataccagaagatgacagtaagaggctgtcctttctgatgaataaaatcaatgtcttcaataaggatatcctaagtttggtacaagcacaagaaaacatatcatgggaagaaagccggctgttcaccaaactgcgaaatgagtttcttgcttggaatgattatattgaggaacatttcaaaaaaaccctaggttcttctgagaaacacagccagatggaaaaatttgaaagtcattatcgtggccgggaactgccagggtttgtggactataaggcatttgagaacattatcaagaaggaagtcaaggccctggaagaacccgctctgaacatgctgcacagggtcactaccatggtcaaaaatgccttcacaaaggtttcatcaaacaattttggtgattttttaaacctccacagtactgccaagtccaaaattgaagacatcagatttaaccaagaaaaagaagccgaaaaactgatccgacttcacttccagatggaacacattgtctactgccaggaccaggcttacaagaaagccttgcaggagatcagagagaaggaagctgagaaagagaagtcaacctttggtgcctttcaacataactctcctcgaaaggagttgactaccactgagatgacccagcacctgaatgcctactaccaggagtgcggaaggaacattgggagacagatccctctgatcatccagtactccatcctgcaaacatttgggcaggaaatggagaaagcaatgcttcagcttctacaggacaccagtaagtgcaactggttcctgactgagcagagtgacagcagagagaagaagaagttcctgaagaggcggcttttaaggctggatgaggctcagcggaagcttgccaaattctccaattaatcaggcttgctatgtgacttccctggtcacagctagcgtcccctgcacaatgaccctttagctgtttaccttatgttagtatgttgcctttagactgtggaagcatgccctctgcaaactctgaggagacgaagagaggagccatggagagtcattctacttcagcagtaagacacgaccctctcaaagcacaggaggctggcacctctcagggtccttcctgctcctaactgccatttctttgtcaggaggatgtcctggctgagtacttcagaagggatgtctcctggctttgtactgctctgcctggagtagtgctagaggtgtgacagagtcctagcaggacagctctttgtaggcataaattttttgcaacctaattttagcaagggttcaacctcacttttagcccaccacccatcagaggtagtgggacagaaaagttattaggatatgggggaagtgctcagcaatagttctttgggggtgagctcaactttctttggcagcataacaaacaccaaataagactcagaagttgcagatcagtcctctaggcaggcagacaccaggcacgaaccagcagctgtagatcaatcttaaagaaagctcgccagccagcctgaggtaaggctgtggaagcagcaaacttcctcagcaacctcacaagtagttcttaggcaagtttcttctaatggtagtgttaccacaagttgagcccaacaatgctatgcaaggcaaaccattacatgcacgttgttagtgaagaataagtaggcagagcaaaccaacgctcagttgctcgtctcccagtgttttgtggggccgtatttatctccttcatcatgggtcctttcacatgtttgcaatattaaatcatcctttcacctgtgtccgcttcaggacaacagtctttcacaagtttgcttcagcaagacaccctttcacctgtgtgccccagcaaaacatcatttgacataactttctaaagaaactagaagtttccacttcaagttcttccaataaaattcttgctaaatg

SEQ ID NO: 2162 - DNA, 1880 bp, Rattus norvegicus
  Genbank Accession No. X52815
gggggggggggctgccgatcgcaatggaagaagaaatcgccgccctcgtcattgacaatggctccggcatgtgcaaagctggctttgctggggacgacgcccccagggccgtgtttccttccatcgtcgggcgcccccgacaccagggtgtcatggtgggcatgggccagaaagactcgtacgtgggtgatgaggcccagagcaagaggggtattctgaccctgaagtaccctattgagcacggcattgtcaccaactgggacgacatggagaagatctggcaccacaccttctacaacgagctgcgtgtggcccctgaggagcacccggtgcttctgaccgaggcccccctgaaccccaaagctaacagagagaagatgacgcagataatgtttgaaaccttcaataccccagccatgtacgtggccattcaggcggtgctctccttgtatgcatctgggcgtaccactggcattgtcatggactctggtgacggggtcacacacacagtgcccatctatgagggctacgcccttccccacgccatcttgcgtctggacctggctggccgggacctgacagactacctcatgaagatcctgactgaaaggggctacagctttaccaccactgctgagagggaaattgttcgtgacataaaggagaagctgtgctatgttgccctggattttgagcaagaaatggctactgctgcatcatcttcctctttggagaagagttatgagctgcctgatgggcaggtgatcaccattggcaatgagcgcttccggtgtccagaggctctcttccagccttccttcctgggcatggagtcctgtggcatccacgagaccaccttcaactccatcatgaagtgtgatgtggacatccgcaaagacctgtatgccaacacagtgctgtctggtggtaccaccatgtatccaggcattgctgacaggatgcagaaggagatcacagccctggctcccagcacaatgaagattaagatcattgctcctcctgaacgcaagtactcagtctggattggcggctccatcctggcctcactgtccaccttccagcagatgtggatcagcaagcaggagtatgacgagtcaggcccctccattgtccaccgcaaatgcttctagatggactgagcaggtgccaggcatctgctgcatgagctgattctgaagtatcgatttgccctggcaaatgtacacacctcatgctagcctcatgaaactggaataagcctttgaaaagaaatttgtccttgaagcttgtatctgatatcagcactggatcgtagaacttgttgctgatttttgaccttgtattcaagttaactgttcccttggtatatgtttaataccctgtgcatatcttgatttagtccttagttcatgtggctcggtcacttggtggctggggagatctgtggaaaagtcagtcagtccccagcctagtggatctctgtgagcaccatgtagtgatctgtgcagggtattaaccaacagcagacttccaggatttcccgaggctggcaagggttcctgaactagttaccacttcttttcttgccagtctaacagggtgggaaagtccgagccttaggacccagtttctgttctggttttttccctcctgacctccatgggttgttacttgccttgagttgggaacgtttgcatcgacacctgtaaatgtattcatccttttaatttatgtaaggtttttgtactcaattctttaagaaatgacaaattttggttttctactgttcagtgagaacattaggccccagcaacacgtcattgtgtaaagagaaataaaagtgctgcagtaaaaaaaaaaaaaaaccccccccccccccc

SEQ ID NO: 2163 - DNA, 535 bp, Rattus norvegicus
  Genbank Accession No. X53378
ctctttgcttccagacctccgccatcatgggtcgcatgcacgctcccgggaagggcctgtcccagtcggcgctgccctaccgccgtagcgtgcccacgtggctgaagttgacgtctgacgacgtgaaggaacaaatttacaagttggccaagaaaggcctgactccttcccagataggtgtgattctgagggactcacatggtgtggcacaggtccgttttgtgaccggaaataaaatcttgagaatccttaagtccaaaggccttgcccctgatcttcctgaggatctctaccatttgatcaagaaagcagttgctgtcagaaagcaccttgagaggaacagaaaagataaggatgctaaattccgcctgattctaattgagagcagaattcaccggctggctcgatactataagactaagcgggtgctcccacccaactggaaatatgagtcatccacagcctctgctctggtggcataaatgctgttgcgtacacaagcaataaaatcactttgagtaaaaaaaaaaaaaaa

SEQ ID NO: 2164 - DNA, 664 bp, Rattus norvegicus
  Genbank Accession No. X53504
ctttcggttcggaggaggcaacggtgcaactttcttcggtcgtcccgaatccgggttcatccgacaccagccacctccaccatgccgcccaagttcgaccccaacgagatcaaagtcgtgtacttgaggtgcaccggaggcgaggtcggcgccacatccgccttggcccctaagatcggtcctctgggtctgtctcccaaaaaagttggtgatgacatcgccaaggctaccggtgactggaaaggcctcaggattacagtgaaactgaccatccagaacagacaggcccagattgaggtggtgccctctgcctctgccctgatcatcaaagccctcaaggagccaccaagagacaggaagaagcagaaaaacattaaacacaatggaaacatcacttttgatgagattgtcaacattgcccggcagatgagacaccggtctttggccagagaactttctggaactatcaaggagatcctgggtactgcacagtctgtgggctgcaatgtggacggccgccaccctcatgacatcatagatgacatcaacagtggtgcggtggagtgcccagctagttaagaagcaacgagaaggggttgggaatttagctcagtggtagagcgcttgccaagcccaaggccctgggttcagtccccagctccgg

SEQ ID NO: 2165 - DNA, 1934 bp, Rattus norvegicus
  Genbank Accession No. X54467
cctataagccggcgacctctggcattaagctttgctctcttcgggccgtcgcgaccatgcagacccccggcgtcttgctgctcattctcggcctcctggatgcgtcctcctccgcgcttatcagaatccccctgcgcaagttcacatccatccgtcggactatgacggaagtgggaggctctgtggaagacctgatccttaaaggtcccataaccaagtactccatgcagtcatctcctaggaccaaggagccagtgtcagagttactaaaaaactacctggatgcccagtactatggtgagatcggcattgggactcccccacagtgtttcacagtcgtctttgacactggctcctctaacctgtgggtcccctccattcattgcaagctgctggacatagcctgctgggtccaccacaagtacaacagtgacaagtccagcacctatgtgaagaatggcacatccttcgacatccactacggctcaggtagcctctctgggtacctgagccaggacactgtgtcggttccatgtaagtcagacttaggaggtatcaaggtggagaaacagatctttggggaagccaccaagcagcctggagtcgtattcatcgcagccaagtttgatggcatcttgggcatgggctacccttttatctctgttaacaaggtgctcccggtcttcgacaacctgatgaaacagaagctggtggaaaagaacatcttctccttctacctgaacagggacccaaccgggcaacctggaggagaactaatgcttggcggcactgactccagatactaccacggggagctgtcctacctgaacgtcacccgaaaggcctactggcaggtgcacatggaccagctggaggtgggcagcgagctgaccctgtgcaagggaggctgtgaggctattgtggacacagggacgtctcttctggtggggcctgtggacgaggtgaaggaactacagaaggccattggggcagtgcctctcatccagggcgagtatatgatcccttgtgagaaggtgtccagcctgcccattatcacctttaagctaggaggccaaaactatgaactacacccagagaagtacatactcaaggtatcgcaggctggaaagacgatctgcctgagtggcttcatggggatggacataccccctcccagtgggccgctctggatcctgggcgatgtctttattggctgctactacaccgtgtttgacagagaatacaatagggtcggctttgccaaggctgccacactctaacttgctccttcttcactgtcagggaactggatcagagtccagtagagaaagccagccagccccatccctccacctgccccactcacacatattcacactcgcctagtgttgctgggcccttgggaggcctggctggagctggtccagctgttctgttctgtggtccctgtccctgggttcagattgctgccctccgcctgtctgaaggaggccaaggcctacccagtacaaaaggctgcctttaaaggcccctactggcttggtagctgccgggatgaattgtcttgtcctgctgccctttgctgcgtgggcagcactctgaagcaggcaaatgggtcttgggatccctcccagaaacctgctctgaccagaccctcaggcagcctggggatggcaccaagctctactgccccactatctctggcctggcaaaggctgaaggtgagcagaaggagcaagaggacagaagcaaaactatatgaacctggggggggttacctgggacctgaccccaccctcctgggaaggcatgcttcagcctggggcagaggtaggatggctgactggttttggctggcctctgctgccctcatcctgggctagtcagatgggagccaaagttgatatacaaataaagttgttttgggcctcttt

SEQ ID NO: 2166 - DNA, 2812 bp, Rattus norvegicus
  Genbank Accession No. X55153
gggatggatccctggatggggccgtctctggatgacctttttctcattctctgctccaaacgttgtctctgtatttccttctgtgaatattttgcagaaccacaatttgaactcctagctaccgacccagcccacgtgcaagacgaaaagggtagaagggagggatcttccggtattaaggtgttaacagtgatgcatcttgggacttgtagttcgcctcaatacgacctgggcggggctccgattgcacgttgggagctgtggagccgtgtggcatgctgggaacgtgaggcgaaaaaggggattgaaaattttcgcccgtgtccccatggatttcgggagactctcgcctatgttacaggagcacttggcacttgaaaaaactcttgtttttgttgtgggaaacacatgaccggggacaaggcaaatttcttgcttccggcgcacccttatcgtcaataggaggcgcccctccgcggcttgttcccggagacttctgggtagcggtttacccccgcccactgcgtcagcatcttcctttcgccgccggacgccgccgaggtcgcacgcgtgaggtctgtccaccgcaaccgagtgagtaccctggccggctggggcgcagatagtggttgggactgagggatggaccgcggccgggagccgagggttgcatattttccgtgatcggaggcctggtgcctcacatggtctcacttgctggttaacaaggagtgggaagcagaaggcctctagggaaacctcaccaccgtaccttccttctctctgtcccattcagcatgcgctacgttgcctcttatctgctggccgccctcgggggcaactccaatcccagcgccaaagacatcaagaaaatactagacagcgtgggcatcgaggcggacgatgaacgactcaacaaggtagcttgctgctcactaggacccactggatccaaatgtctactagtagcggtccttaaatgttaggtccggattttacccttagagaaaatgtataggacctgttgaaaagggtggaaggaggaggcctacacccgtcttagtcatagttttctctttaatccttttgaggaccttgtgcaagtcaaagaaaatccgggcatgacaaaagtcctgctcatcgtgcttttgtagaagtttaatactactcgcttgtgggacttttgagatcaggtttactgtgtagctctgactaacctggaacgcactgtgtaaactagtttccttaactttttcctttttgaaactaacttggcagtaaaggatttacgcccacaagtgagaaacatctggtctccctggatctatagttagggttagctgataaatgtaagtgctgggagtcaaactcttaagatatggtgagtccgagctgtacagtgtgatcttacctggaaaagaacaggtcttcacagaatcttagaattttagtacctaaaacttgccactgccaacatctttgttgagaagacccagtactgtctcacggctagttactggggtagggtacaagtaggacaccttcccgtgtctgtctgtcttgcattactgactgctggttgtggttgtctattccaggtcatcagtgagctgaatggaaagaatattgaggatgtcatcgctcagggtgagttcctgggaagtgaacatgtttgtggtccatcctaatccctgctggtcagcccgtgatctgccaggcttcgcttgtggaccagagcatcctagaaaccctgccagagttgtgcgaggcctttttgtgtgcttgtgccggcagcgcttctgaacacgctggagctggcaatggggtcatttgttgattgctcctaccaggatgtgaaagccttttctgtgagcagggactgggggcactaaaaaattggtgcaggctctttcttaacttttattaggcatacagatttctggtaccaccagactacatcttatttgcaatctgaacagttaactgcacacgagaagcaaaaccagctcagcaactgacctagttagtctgtgaacctcaccccaaaagagctttgggcattgggtcacgctcatggtaaacacgttctcttgatttttagttaactaaaagtttgtgggttttccttttttttatttttttaagattttatataagtacactgtctccatcttcagacacacgagaagagggcatcagatctcatcatagatggttgtaagccaccatatggttgctgggaattgaactcaggacctctggaagagcagtcagtgctcttaaccactgagtcatctctccagcccggaaaacaagtcttaaacagtattaatggtgttcctaagtgtgtgcaaagttgcattgtgttttagagtgaaagcaggtggcagtggtgttccttgtgttggtgagtctacccttacagaacagcctttctggctgggtctctgttctgtctggtctcatgttctttctattttaacataggtgttggcaagctggccagtgtgcctgctggtggggctgtggctgtttctgctgcccctggctctgcagctcctgctgctggttctgcccccgctgcaggtaaatagaggtctgatgagtgggtggtgatcaaagggggggttggtgctcagagtttattttattgttggccggggctcctgggaaaatctggatgcttactatggtgttcctccacagcagaggagaagaaagatgagaagaaagaggagtctgaggagtcggatgacgacatgggatttggcctgtttgattaagatcccctgccaataaagcctttttatgt

SEQ ID NO: 2167 - DNA, 8221 bp, Rattus norvegicus
  Genbank Accession No. X57405
ggcgggtcagggagcgcaggggcgtggggcgcagggccgggtgcagcgcagtgaaggaacgagcctgggttgccctgtagtgccggggagaccctgagagcccagcccgcccacccgccaggaaagagggcagcagcgggtggaacgcccgcgggaccgcccgtggtgcgcgtgaacgtccgatcccggccggccaccgcaagaggccgccgcccggcagcgggcagctggcgagcaggcatgccgcggctcctggcgcccttgctctgcctaacgctgctgcccgcgctcgccgcaagaggcttgagatgctcccagccaagtgggacctgcctgaatggagggaggtgcgaagtggccaacggcactgaagcctgtgtctgcagcggagcgttcgtgggccagcgatgccaggaccccagcccttgcctcagcacaccatgtaagaatgctggaacgtgctatgttgtggaccatggcggcatcgtggactatgcctgcagttgccccctgggtttctctgggcccctctgcctgacacctctggccaatgcctgcctggccaacccctgccgcaacggggggacctgtgacctgctcactctcacagaatacaagtgccggtgcccgccagggtggtcaggaaagtcatgtcagcaagccgacccctgtgcctccaacccctgtgccaatggtggccagtgcctgccctttgagtcttcatacatctgtggctgcccgcccggcttccatggccccacctgcagacaagatgttaacgagtgcagccagaaccctgggttgtgccgtcatgggggcacgtgccacaatgagattggctcctatcgctgtgcctgccgtgccacccacactggtccccactgcgagctgccctacgtgccctgcagcccctcaccctgccagaacggaggcacctgccgccctacgggggacaccacccacgagtgtgcctgcctgccaggctttgctggacagaactgtgaagaaaatgtggatgactgcccaggaaacaactgcaagaacgggggtgcctgtgtggacggtgtgaatacctacaattgccgctgcccaccggagtggacaggtcagtactgcacagaggatgtggacgagtgtcagctcatgcccaacgcctgccagaatgcgggaacctgccacaactcccacggtggctacaactgcgtgtgtgtcaatggctggactggtgaggactgcagtgacaacattgatgactgtgccagtgccgcctgttttcagggtgccacctgccatgaccgtgtggcttccttctactgcgagtgtccacatgggcgcacaggcctgctgtgccacctgaacgatgcgtgtatcagcaacccctgcaacgagggctccaactgcgacaccaaccctgtcaacggcaaggccatctgcacttgccctcgggggtacacggggccagcctgcagccaggacgtggatgagtgcgctctaggtgccaacccgtgtgagcacgcgggcaagtgcctcaacacactgggctctttcgagtgtcagtgtctacagggctacactgggccccgctgtgagattgatgtcaacgagtgcatctccaacccatgtcagaatgatgccacgtgcctggaccagattggggagtttcagtgtatatgtatgccaggttatgagggtgtatactgtgagatcaacacggacgagtgtgccagcagcccctgtctacacaatggccgctgcgtggacaagatcaacgagttcctgtgtcagtgtcccaaaggcttcagcgggcacctgtgccagtatgacgtggatgagtgcgccagcacaccatgcaagaacggcgccaagtgcctggatgggcccaacacctacacctgcgtgtgcacagaaggttacacggggacccactgcgaggtggacattgacgagtgtgaccctgacccctgtcacattggtttgtgcaaggatggtgtggccacctttacctgcctctgccagccaggctacacaggccatcactgtgagaccaacattaatgagtgtcacagccagccgtgccgccatggcggcacctgccaggaccgtgacaactactacctctgcttatgcctcaaggggaccacaggacccaactgtgagatcaatctggatgactgtgcgagcaacccctgtgactctggcacgtgtctggacaagatcgatggctacgagtgtgcgtgcgagccaggctacacagggagcatgtgtaatgtcaacattgacgaatgtgcgggcagcccctgccacaacgggggcacctgtgaggatggcatcgccggcttcacttgccgctgccccgagggctaccacgaccctacgtgcctgtctgaggtcaacgagtgcaacagtaacccctgcatccatggagcttgccgggatggcctcaatggatacaaatgtgactgtgcccctgggtggagtgggacaaactgtgacatcaacaacaatgagtgtgagtccaacccttgtgtcaacggtggcacctgcaaagacatgaccagtggctacgtatgcacctgccgagaaggcttcagtggccctaactgccagaccaacattaacgaatgtgcttccaacccctgcctgaaccagggcacctgcattgatgatgtcgctgggtacaaatgcaactgccctctgccctatacaggagccacatgtgaggtggtgttggccccatgtgccaccagcccctgcaaaaacagtggggtatgcaaggagtctgaggactatgagagcttttcctgtgtctgtcccacaggctggcaaggtcaaacctgcgagatcgacatcaatgagtgtgtgaaaagcccgtgtcgccatggtgcctcttgccagaacaccaatggcagctaccgctgcctctgccaggctggctacacgggtcgcaactgcgagagtgacatcgatgactgccgacccaacccatgtcacaacgggggttcctgcactgacggggtcaacgcggccttctgcgactgcctgcccggcttccagggtgccttctgtgaggaggacatcaacgaatgcgccacgaatccatgccaaaatggcgccaactgcactgactgcgtggacagctacacgtgcacctgccccaccgggttcaatggcatccattgcgagaacaacacacctgactgtaccgagagctcctgtttcaatggtggcacctgtgtggatggtatcaactccttcacctgtctgtgcccacctggcttcacgggcagctactgccagtatgacgtcaatgagtgtgactcacggccctgtctgcatggtggcacctgccaagacagctatggtacctataagtgtacctgcccacagggctacactggtctcaactgccagaaccttgtgcgctggtgtgactcagctccctgcaagaatggcggcaagtgctggcagaccaacacacagtaccactgcgagtgccgcagcggctggactggcttcaactgcgacgtgctcagtgtgtcctgcgaggtggctgcacagaagcgaggcatcgatgtcactctcctatgccagcacggagggctctgtgtggatgaggaagacaagcattactgccactgccaggcaggatacacgggcagctactgtgaggacgaggtggacgagtgctcacctaatccctgccagaacggagccacctgcactgactatctcggtggcttttcctgcaagtgtgtggctgggtaccatggctctaactgctctgaggagatcaacgagtgcctatcccaaccctgccagaatgggggtacctgcattgatctgaccaacacctacaagtgctcctgccccaggggcacacagggtgtacactgtgagatcaacgtcgatgactgccatcctcccctagaccctgcttcccgaagccccaaatgcttcaataatggcacctgcgtggaccaggtgggtggctatacctgcacctgcccgccaggcttcgtcggggagcggtgcgagggcgatgtcaatgagtgtctctccaacccctgtgacccacgtggcacccagaactgcgtgcagcgtgttaatgacttccactgcgagtgccgggctggccacactggacgccgctgtgagtcggtcattaatggctgcaggggcaaaccatgcaggaatggaggtgtctgtgctgtggcctccaacaccgcccgtggattcatctgtaggtgccctgcccgcttcgagggtgccacttgtgaaaatgacgcccgcacttgtggcagtttgcgctgcctcaacggtggtacgtgcatctcaggcccacgcagtcccacctgcctatgcctgggctccttcactggccctgaatgccagttcccagccagcagcccctgtgtgggtagcaacccctgctacaatcagggcacctgtgagcccacatccgagagccctttctaccgctgtctatgccctgccaaattcaacgggctgctgtgccacatcctggactacagcttcacaggtgcggccgggcgcgacattcccccgccacagattgaggaggcctgcgaactgcctgagtgccaggaggatgcaggcaataaggtctgcaaccttcagtgtaataatcacgcgtgtggctgggacggcggcgactgctccctcaacttcaatgacccttggaagaactgcactcagtccctgcagtgctggaagtattttagtgacggccactgtgacagccagtgcaactcagctggctgcctttttgatggcttcgactgccagctcaccgagggacagtgcaaccccctgtatgaccagtactgcaaggaccacttcagtgatggccactgcgaccagggctgcaacagtgccgagtgtgagtgggatggactggactgtgcagagcatgtccccgagcgactggcagccggcacactggtgctggtggtgctgcttccgcccgatcagctacgcaacaactccttccacttcctgcgggacgtcagccacgtgctgcacaccaacgtggtcttcaagcgtgacgcgcagggccagcagatgatcttcccctactatggccgcgaggaagagctacgcaagcacccgatcaagcgttctgcagtgggctgggccacaacgtcactgcttcctggcaccaatggtgggcgccagcgcagggagctggaccccatggacatccatggctccatcgtctacctggagatcgacaaccggcagtgtgtacagtcatcctcgcaatgcttccagagcgccaccgatgtggctgccttcctaggtgctcttgcctccctcggcagcctcaatatcccctacaagatcgaagccgtaaagagtgagacggtggagcctccgctgccctcacagctgcacctcatgtacgtggcggcagctgccttcgtgctcctgttctttgtgggctgtggggtgctgctgtcccgcaagcgcaggcggcagcatggccagctctggttccctgagggtttcaaagtgtcagaggccagcaagaagaagcggagagaacccctcggcgaggactcagtcggcctcaagcccctgaagaacgcctcagatggtgccctgatggacgacaatcagaacgagtggggggacgaagacctggagaccaagaagttccggtttgaggaaccagtggttctccctgacctggatgatcagactgaccaccggcagtggacccagcagcacctggatgccgctgacctacgtgtgtctgccatggccccaacgccgcctcagggggaggtagatgctgactgcatggacgtcaatgttcgaggaccagatggcttcactcccctaatgattgcctcctgcagcggagggggcctggagacaggcaacagtgaggaagaagaagatgcacctgctgtcatctccgacttcatctatcagggtgccagcttgcacaaccagacggaccgcacaggggagactgccctgcacctggctgcccgatactctcgttcagatgctgccaagcgcttgctggaggccagcgcagatgccaacatccaagacaacatggggcgtaccccattacatgccgctgtttctgcagacgctcagggtgtcttccagatcctgctccggaacagagccacagatctggatgcccgaatgcatgatggcacaacccctctgatcctggcggcacgcctggccgtggaaggcatgctagaggacctcatcaactctcacgctgatgtcaatgctgtggatgacctaggcaagtcagctctgcactgggcagccgctgtgaacaatgtggacgctgctgttgtgctcctgaagaacggagccaacaaagacatgcagaacaacaaggaggagactcccctgttcctggccgcccgtgagggcagctatgagactgccaaagtgttgctggaccactttgccaaccgggacatcacggatcacatggaccgattgccacgggacattgcacaggagcgcatgcaccacgatatcgtgcggcttttggatgaatacaacctggtgcgcagcccacagctgcatggcactgccttgggtggcacacccactctgtctcccacactctgctcgcccaacggctacctgggcaacctcaagtctgccacacagggcaagaaggcccgaaagcccagcaccaaagggctggcttgcagtagcaaggaagctaaggacctcaaggcccggaggaagaagtcccaggatggcaagggctgcctgttggacagctcaagcatgctgtcacccgtggactccctcgagtcaccccatggctacttgtcagatgtggcctcaccacccctccttccctccccgttccagcagtctccatccatgcctctcagccacctgccaggtatgcctgacacccacctgggcatcagccacttgaatgtggcagccaagcccgagatggcagctctggccggaggcagccggttggcctttgagccacccccaccacgcctctcccacctgcctgtagcctccagtgccagcacagtgctgagtaccaatggcacaggggctatgaatttcaccgtgggtgcaccggcaagcttgaatggccagtgtgagtggcttccccggctccagaatggcatggtgcccagccagtacaacccgctaaggccaggtgtgactccgggcacactaagcacacaggcagctggcctccagcatggcatgatgggcccgatacacagcagcctctccaccaataccttgtccccgattatctaccagggcctgcccaacacaaggctggccacacagccccacctggtgcagacccagcaggtgcagccacagaacttacaaatccagcctcagaacctgcagccaccatcgcagccacacctcagtgtgagctcagcagccaatgggcacctgggtcggagcttcctgagcggggagcccagccaggcagacgtacagccgctgggccccagcagtctgcctgtgcacaccattctgccccaggaaagccaggctctgccgacatcactgccatcctccatggtcccacccatgaccactacccagttcctgacccctccttctcagcacagctactcatcctcacctgtggacaacacccccagccaccagctgcaggtgccagagcaccccttcctcaccccatcccctgagtcccctgaccagtggtccagctcctcccggcattccaacatctctgattggtccgagggcatctctagcccgcccacgagcatgccgtcccagatcacccacattccagaggcatttaagtaaacagagatgtgggatgaaggaccccagcttccgttcccaagctctgttgggagtcctttccagtgctccaggatgctggggcgaccaaaggagccttttaaaaaaaaatgtttttatacaaaataagaggacaagaatttccattttttttttagtatttatttatgtacttttattttccacagaaacactgcctttttatttatatgtattgttttctatggcactaggggaaaacatctgttccaagaaaataaactagttctgagagcctcgattttcctggtcagggtgaagttccctgtgtgtttgtaaaatacgaacaaggattcatgatttgtaaatgccgtttatttattgattgcttctttccaaaatcgtcgag

SEQ ID NO: 2168 - DNA, 516 bp, Rattus norvegicus
  Genbank Accession No. X57529
cacaggaggcctacacgccgccgcttgtgccgccgccatgtccctagtgatccccgagaagtttcagcacatcctgcgagtactcaacaccaacatcgatgggcggcggaaaatagccttcgctatcactgccattaagggtgtggggcggagatacgctcatgtggtgttgaggaaagcagacattgacctcaccaagagggctggggagctcacggaggacgaggtggagcgtgtgatcaccatcatgcagaacccacgacaatacaagatccctgactggttcttgaacagacagaaggacgtgaaggatgggaagtatagccaggttctggccaacggtctagacaacaagctgcgtgaggacctggagcggctgaagaaaatccgagcccatagaggactgcgccacttttggggccttcgtgtccggggtcagcacaccaagaccactggccgcaggggccgtactgtgggtgtgtccaagaagaaatgagtctttgggcctttgctgtt

SEQ ID NO: 2169 - DNA, 499 bp, Rattus norvegicus
  Genbank Accession No. X58200
ctctttccggacgctcaagatgtcgaagcgaggacgtggtgggtcctccggagcgaaattccggatttccctgggtcttccggtaggagctgtgatcaactgtgctgacaacacaggagccaaaaacctgtatatcatctctgtgaagggaatcaagggacggctgaacagacttcctgctgctggtgtgggcgacatggtgatggccacagttaagaaaggcaaaccagaactaaggaaaaaggtacatcctgcagtggtgattcgacaacgaaagtcatatcgaagaaaagacggggtgttcctttattttgaagataatgcaggggtcatagtaaacaataaaggcgagatgaaaggttctgctatcacaggtccagttgcaaaggagtgtgcagacttgtggcccaggattgcatccaatgcaggaagcattgcctgattctccagtgtgtttgtaaaatatattcattaaagtcttctctctgaaaaaaaaaaa

SEQ ID NO: 2170 - DNA, 628 bp, Rattus norvegicus
  Genbank Accession No. X58389
cctgttagcggccagaggtaacctgtgaagatggttcgctactcccttgacccagaaaaccccacgaaatcatgcaagtcaagaggctcaaaccttcgtgttcactttaagaacacccgggaaactgcccaggccatcaagggtatgcatatccgcaaagccaccaagtatctgaaggatgtcactttaaagaagcagtgtgtgccattccggcggtataatggtggagtcggtaggtgcgcccaggccaaacagtggggctggacacagggacggtggccaaaaaagagtgctgaatttttgctgcacatgcttaaaaatgcagagagtaatgctgaacttaagggtttggatgtagactctctggtcattgaacacatccaggtgaacaaggctcctaagatgcgcagacgaacctacagagctcacggccggattaacccatacatgagctccccctgccacatcgagatgatcctcactgagaaggaacagattgttccaaagccagaagaggaggttgcacagaagaaaaagatatcccagaagaaattgaagaaacaaaagctcatggcacgggaataaattcagcataaataaatgcggataaagtaaaaaaaaaaaaaaa

SEQ ID NO: 2171 - DNA, 744 bp, Rattus norvegicus
  Genbank Accession No. X58465
ctcttcctgtctgtgccagaactgcgcgtggtccgcgccgatcgactgagaagcccggtttgcgctctcagaatgactgaatgggaaacagccacacccgcggtggcagagaccccggacatcaagctctttgggaaatggagcactgatgatgtgcagatcaacgatatttctctacaggattacattgctgtgaaggagaagtatgccaagtacctgccccacagtgcaggacggtatgctgccaacggtttccgcaaagcacagtgtcccatcgtggagcgccttactaactccatgatgatgcacggtcgtaacaacggcaagaagctcatgactgtacgaattgtcaagcatgcctttgagatcatccacctgctcactggtgagaaccctctgcaggtcctggtgaatgctatcatcaacagtggcccccgagaagactcaacacgcattgggcgggctggaacagtgagacggcaggctgtggatgtatccccacttcgccgagtgaatcaggccatctggctgctgtgcacgggggctcgtgaggctgctttccggaacatcaagaccatcgctgagtgccttgcagatgagctcattaatgctcgcaagggctcctccaactcctatgctatcaagaagaaagatgaactggagcgtgtggccaagtctaaccgctgatttcccagctgctgcctaataaattgtgtgccctttgggacagttacatcaaaaaaa

SEQ ID NO: 2172 - DNA, 497 bp, Rattus norvegicus
  Genbank Accession No. X59375
aaagttgctgctaggcgctcgaaagcgagcacctcatctcagagatctggagcggccgcgcttgcggagctgtcaccatgcctctggctagagatctattacacccttccttggaagaggaaaagaaaaaacataagaagaaacggctggttcagagcccaaattcttacttcatggatgtgaaatgtccaggttgctacaagattactacagttttcagccatgctcagacagtggttctttgtgtgggttgttcaaccgtgctgtgccagcccacaggagggaaagccaggctcacagaaggctgttcatttagaagaaagcaacactaatcatctatacaagttcctgaattcgtgtttttcacagaaagccttatcaactttagttactctaccaagacaatgtaattattgtttgattttataaagtctacaacaatgatctcctattttggtgtcagtttttcaataaagttttacttatgaacaagttca

SEQ ID NO: 2173 - DNA, 1543 bp, Rattus norvegicus
  Genbank Accession No. X59737
cgtagaaactcaccattccctgcccaaccccagccccacacccagagcaatcaacagttccagatttgcgccagatcctgctccaaatccggtagccgcatcccaagccatggctggtcccttctcccgtctgctgtctgcccgccccggactcaagctcctggctttggctggagctgggtctctcgccgccgggattctgctccgtccggaatctgtacgagcggccaccggtgaacggaggagactgtatcccccgagcgctgagtacccagacctccgaaagcacaacaactgcatggccagtcacctgaccccagcagtctatgcacggctctgcgacaagaccacacccactggctggacactagatcagtgcatccagactggagtggacaaccctggccaccccttcatcaagactgtgggcatggtggctggagatgaggagacctatgaggtatttgccgaactgtttgaccctgtgatccaagagcggcataatggatatgaccctagaacaatgaagcacaccactgaccttgatgccagcaaaatccgttctggctactttgatgagaggtacgtattgtcctcaagagtcagaactggccgaagtatcaggggactcagtctccctccagcctgcactcgggcagagcgacgagaggtggagcgtgttgtggtggacgcgctgagtggcctgaagggcgacctggctggacggtactacaggctcagtgagatgacagaggctgagcagcagcagcttattgacgaccatttcctgtttgataaacctgtgtccccattgctgacagcagcaggcatggctcgagactggccagatgcccgaggaatctggcacaacaatgagaagagtttcttgatctgggtgaatgaggaggaccacacacgggtcatctctatggagaaaggcggcaacatgaagagagtgtttgaaagattctgccggggcctcaaaaaggtggagaagctgatccaggaacgaggctgggagttcatgtggaatgagcgtttaggatacatcttgacctgtccatctaacctgggcactggacttcgggcaggagtacacgtcaaactgccactgctaagcaaagatagccgcttcccaaagatcctggagaacctaaggctgcaaaagcgtgggactggaggagtggacacgcctgccacagcggatgtctttgacatctctaatctggatcgacttggcaagtcagaggtggagctggtgcagctggtcatcgatggggtgaactatttgattgactgtgaacggcgtctggagaaaggacaggatattcgaatccctccacctcttgtccacggcaaacattaactccccgtccccagcagctgaatcaagattccccaggacttctgcatatttaacagtggcccattctacttgccaaggacctgcctctcaatccctgtcctagtaaagactccacgttctgttgcaaaaaaaaaaaaaaataaagttcctatttctctgcaaaaaaaaaaaaaaaaa

SEQ ID NO: 2174 - DNA, 1547 bp, Rattus norvegicus
  Genbank Accession No. X59859
gcacaagtttcctgggctggaccatttgagcagagaggattatttgacttcatgctagaagatgaggcctctggcataatcccttacgaccctgacaatcccctgatatctatgtgcccctaccgatgccaatgccatctccgagtggtgcagtgttctgatctgggtctggacaaagtaccctgggaatttccacctgacacaacattgctagacctgcaaaacaacaaaataacagagatcaaagagggggcctttaagaacctgaaggacttgcataccttgatccttgtcaacaacaagatcagcaagatcagcccagaggcatttaaacctctagtgaagttggaaaggctttatctgtctaagaaccacctaaaggagctgcccgaaaaattgcccaaaacactccaggagcttcgactccacgacaatgagatcaccaaactgaagaaatctgtgttcaatggactgaaccgtatgattgtcatagaactgggcggcaacccactgaaaaactctgggattgaaaatggagccttgcagggaatgaagggtctcggatacatccgcatctcagacaccaacataactgctattcctcaaggtctgcccacttctatcagtgaactgcatctggatggcaacaagatagccaaagttgatgcagccagcctgaaaggaatgtctaatttgtctaagctgggtttgagcttcaatagcatcaccgttgtggaaaatggcagtctggctaatgttcctcatctgagggagctccacttggacaacaacaaactcctcagagtgcctgctgggctggcacagcataaatatgtccaggtcgtctaccttcataacaacaacatctccgaagttgggcagcatgacttctgcctcccttcataccagactaggaagacttcctacactgccgtgagtctttatagcaaccctgtccggtattggcaaattcacccacacaccttcagatgtgtcttcgggcgctctaccattcaacttgggaactacaagtaactcccaaacagcctcatttttataatcgggaacaaaaaaaccaatctgtcaatattattgctaaaaagaaaaaaatattttgaaaaagaaagaatgctagattctggaaattcaagtatagcgcggatgcctttcccgtatgacttatcatgcatcaagccaaatatacagattgaataattacctacaataaaaatattttatctgtagtattcagaatcacttttaaaattttctgtagatgtgaactgaggtatcgaagtctgatgtaatcatagatgtcaacatttaataaagctaaaaggaacagaatacaaagtcttctgtaattcatagagctaaattgactcttttgacataaagtcaaatgtagaactctagcaatgtattaatctcctttattattggtaaagtcttatttgaatatctaagttcaacatgggctatgtaaaattttcactgtcatactgaaaaacaataaaatttaaaaaatgcattcaaaaaaaaaaaaa

SEQ ID NO: 2175 - DNA, 498 bp, Rattus norvegicus
  Genbank Accession No. X61381
tgtgtgcgatcgcggtggatcgctaccatgaaccacacttctcaagccttcgtgaacgctgccactgggggacaacccccaaactacgaaagaatcaaggaagaatatgaggtgtctgaactgggggctccccacggatcggcttctgtcagaactaccgtgatcaacatgcccagagaggtctctgtgcctgaccatgtggtctggtccctgttcaatacgctcttcatgaacttctgctgcctgggcttcattgcctatgcctactctgtgaagtctagggatcggaagatggtgggtgatatgactggagcccaggcctacgcatccactgccaaatgcctgaacatcagctccctggtcctcagcatcctcatggtcattatcactattgttactgtcgtcatcattgctcttaatgctcctcgtctccagacttgatagaggattctggtttctgatcctgacgtgcttcacgctctgctggctgcccttttt

SEQ ID NO: 2176 - DNA, 843 bp, Rattus norvegicus
  Genbank Accession No. X62145
ctcttttggccttgcttgccggcagactcgccgccatgggccgtgtgatccgaggccagaggaaaggtgccggttctgtgtttcgtgcgcacgtgaagcaccgtaagggagccgcgcgtctgcgtgctgtggacttcgcggagcgacacggctacattaaaggcatcgtaaaggacatcattcatgaccctggccgcggcgctcccctcgcgaaagtagtctttcgtgatccctatcgattcaagaagcggacagagctgttcattgccgcagagggaatccacactggacagtttgtgtactgcggcaagaaggcccagctgaatattggcaatgttttgcccgtgggcaccatgcctgagggtactatcgtgtgttgtctggaggagaagcctggggacaggggcaagctggcacgagcctccgggaactatgctacagtcatctcccacaacccagagaccaagaagacccgagtgaagctgccttcagggtccaagaaggtcatttcctctgctaaccgagctgttgttggtgtcgtggctggcgggggcagaattgacaagcctatcttaaaggctggccgtgcctaccataagtacaaggcaaagaggaactgctggccacgtgtgcggggtgttgccatgaatcctgtggagcatccctttggcggtggtaaccaccagcacattggcaagccttccactatccgaagagatgccccagctgggcgcaaagtgggtctcattgctgctcgccggactggacggctacgtggaaccaaaactgtacaggagaaggagaactagagttcaggagctaataaagtatgtgctttggcta

SEQ ID NO: 2177 - DNA, 1316 bp, Rattus norvegicus
  Genbank Accession No. X62166
cgagacatatcggcggcgtgtggcggcgagatgtctcacaggaaattctcagctcctaggcatgggtccttgggcttcttgcctcggaagcgcagcagccggcatcgtggaaaagtgaagagcttccctaaggatgacccttccaagcctgttcacctcacagccttcctagggtacaaggctggcatgacccacattgtccgggaagttgaccggccaggatctaaggtgaataagaaagaagttgtggaggctgtgaccattgtggaaaccccacccatggtggttgtgggtattgtgggatatgtagaaaccccacgaggcctccggaccttcaagactgtatttgctgagcacatcagcgatgagtgtaaaaggcgtttctataagaattggcacaaatctaagaagaaggcttttaccaagtactgtaagaaatggcaagatgacacaggcaagaagcagctggagaaggacttcaacagcatgaagaagtactgccaggtcatccgcataattgctcacactcagatgcgcctgcttcctctgcgccagaagaaggcacacttgatggagatccaggtgaatgggggcactgtagctgagaagctagactgggcccgagagaggctggagcagcaggtccctgtgaaccaggtgtttgggcaagatgagatgattgacgtcatcggcgtgacaaagggcaaaggctacaaaggggtgaccagtcgttggcatacaaagaagctgccccgaaagacccacagaggtctgcgcaaagttgcttgtattggagcttggcatcctgcccgtgtagccttctctgtggctcgagctgggcagaaaggctaccatcaccgaacagagatcaacaagaagatttacaagattggtcaaggctacctcatcaaggatggtaagctgatcaagaacaatgcatctactgactacgacctgtctgacaagagcatcaacccactgggtggctttgtccattatggtgaggtgaccaatgacttcatcatgctcaaaggctgtgtggtgggaaccaagaagcgagtgcttactctccggaagtccttgctggtccagaccaagcgtcgggctcttgagaagattgacctgaagttcattgacaccacctccaaattcggacatggtcgcttccagaccatggaggaaaagaaagcattcatgggaccgctcaagaaagatcgcattgccaaggaggaaggtgcctgatgccaggagtactttgtgcagctggtggggtctcatcaataaaatattttcaattaaaaaaaaaaaaaaaaaaa

SEQ ID NO: 2178 - DNA, 410 bp, Rattus norvegicus
  Genbank Accession No. X62325
atgaaatccttgagtgtttcactagtgctcctgtggctccagctaaacggggtgagcagccagcagaaggtgcagcagagcccagaatccctcattgtctcagagggagccaaagcctctttcaactgcactttcagtgatagtacttctgattatttctggtggttcagacagtattctgggaaaagccccaaggccctgatgtccatcttctccaatggtgacaagcaagaaggcagattcacagttcacctcaataaaaccagcctgcatgtttccctgcacatcaatgactcccaacccactgactctgctgtctacctctgtgcagtgagtgcgaaaataatgcaggtgccaagctcacgtttggagggggaacaaggttgacggtcaaaccccatgtcacagac

SEQ ID NO: 2179 - DNA, 785 bp, Rattus norvegicus
  Genbank Accession No. X62875
gccccgatggctgacctggcggcagcagtgtggtcagtgcaggggaagcttaggtcccagcatgtatgtcccccatcaagcgtcaccgggtgggtttctcagtccctcctgccccaccctactgagaatcctgcaccaggttggctgagccccttggctggacaacaggaagtaggatggtgttggctccacccactttgctgctcttccctgggacaagacagatgggcgctaccacccatctcgagtgaggtcctgagcacttccacctaaggcagacggggctccaacaggcgcctcccccactacactcttcctctagcagggcaccaaggagctcgccttgcccccctctccttttgctcctccctgcccccaaggttctggttccactttttcctctgttcacaaactacctctggacagttgtgttgtgttttttgttcaaatgttcattcttagacacccaccattgctgctaccagcgccagatgtccatcctcccgattttgcctgtaccccccacacaatacactctaggggaagggggggctggtgtgcagcagcaggctggttaccgagtaccccacgctagggaagatggccccgccccgtggatgctgcagcagagtgaggagggggggcccacttggatgggaaaagggtataggaccacctccccttgttgtgggggaggggtggccagtatttgtcccagcctggggctccccctctggtttcctatttgcagttacttgaataaaaaaaaatagccttttctggac

SEQ ID NO: 2180 - DNA, 1798 bp, Rattus norvegicus
  Genbank Accession No. X63369
cgaaccgactgtcggtctcttctccatggccattcgcgccaccatggatctctctgccatctacgagagccttatgtcgatgagccatgacctgtcacccgaccacggaggaactgagtcctccggaggactttggaacataaactcatcggactccatcccatctggggtcacctctcgcctgactggccgctccactagcctggtggagggccgaagctgcagctgggtacccccaccccctggtttcgcacccttggctccccgcccgggccctgagctgtcaccctcacctacttcgcctactgcaactcccaccacctcctctcgatacaagactgagctctgtcggacctactcagagagcgggcgttgtcgctatggggccaagtgccagtttgcccacggcccgggtgaactgcgccaagccaatcgccaccccaagtacaaaacggaactctgccacaagttctacctccagggccgctgcccctacggctctcgatgccacttcatccacaaccctaccgaggacctggctctccctggccagccccatgtgctccgacaaagcatcagcttctcaggcttgccttcaggccgcagaacctcaccaccacctccaggcttctctggcccttccctgtcctcttgctccttttcgccttccagctccccaccaccgcctggggaccttccactttccccttctgccttctctgctgcccctgggacccctgtgtctcgaagagaccctaccccagcctgttgtccctcctgccgaaggtctactacccctagcaccatctgggggcccttgggtggtctggctcggagcccatctgcacactctctgggatccgaccctgatgattacgccagcagcggcagcagcctgggtgggtcagactcgcctgtctttgaggccggggtgtttgggcctcctcagccccctgcacccccaaggcgtcttcccatcttcaatcgcatctctgtctctgagtgacaagtgcctgcccagtgtggatcagctagatctcaaagaagagggagggaactgctcgttgctgtggggacctggggggactcctctaagtccctcctcctggacattccaagttgcattaacccattcccctggtgctgggctagggcaggtccctagtttgcaaattcagtgtttgggtggatccgttcctagggtacctgagatgtagcatgtttgaggggtacagttgacagttgatcttccaggtctcaagtcttatgttgtttctgagataggggattattacggtaccccaggctggctttgaactcaatataatcctgccttagccttttccaagttctggggttacaggtatgcaccagcccctcggaaactctggtctcctggaatcttaagtgctgtgaagagccggctcccacaatactatcctaatttttactagaccccgaagttcagtgtccggtggttgtagcctctcctgagaatcctggtgctcaaatttccctcccaaagcaaatagccaaagccattgccaaatcccttttcccccacgcccctgccccaaccaatggacccttttatttatgacgactttatttattgtaataagattttatagtatttatatatattgggtcgtctactccgtttttctttttgtaatgttaaaactgatactgtattaagtatatactataatatattaagtaatatattgttaccgtacaagtctatttttgtgggtttttttggaatttttaaataaaatcttgagtgtgaaaaaaa

SEQ ID NO: 2181 - DNA, 1508 bp, Rattus norvegicus
  Genbank Accession No. X63594
cccaactgccagcagcctgcaccctgcacccgctcagctccgcacagccatgtttcagccagctgggcacggccaggactgggccatggagggcccgcgggacggcctcaagaaggagcggttggtggacgaccgccacgacagcggcttggactccatgaaggacgaggattacgagcagatggtgaaggagctgcgggagatccgcctgcagccgcaggaggcgcctctggctgccgagccctggaagcaacagctcacggaggacggagactcgttcctgcacttggcaatcatccatgaagagaagacactgaccatggaagtgattggtcaggtgaagggagacctggccttcctcaacttccagaacaacctgcagcagactccactccacttggctgtgatcaccaaccagccaggaattgctgaggcacttctgaaagctggctgtgatcctgagctccgagactttcgaggaaatacccctctccatcttgcctgtgagcagggctgcctggccagtgtagcagtcttgactcagacctgtacgccccagcatctccactccgtcctgcaggccaccaactacaacggccacacgtgtctacacttagcctctatccatggctacctgggcatcgtggagcacttggtgactttgggtgctgatgtcaacgctcaggagccctgtaatggccggacagccctccaccttgcagtggacctgcagaatcctgacctggtctcgctcctgttgaagtgtggggctgatgtcaacagagtaacctaccagggctactccccctaccagcttacgtggggccgcccaagtacccggatacagcagcagctgggccagctgaccctggaaaatcttcagacgctgcccgagagtgaggatgaggagagctatgacacggagtcagaattcacggaagatgagttgccctacgatgactgtgtgtttggaggccagcgtctgacgttataagaggaaagtggccaaaggaacgtggacttgtatatttgtacaaatagagttttatttttctaaaaaaaaaaaaaaaaaagaaaaagaaaaaaaataagaaaggatacttagcaccacagcacacagcgcctagccccgagcattctattgtggtgattcagctgttgttcttctcaaatttggggaaacagatcattgaaattcaaaggaaatgtctcctaaggttcatgtttgtgggattttttttttttttttgaggtgattttccagaatctgataaaaggaccacatttaatttatgtgcttttggttgaaccgccatagacgtagctgaccccagttgccctctacgtaagaaccaggtcgatagtggtatgtgcttaagcaccccagctgagatttgtaccactttcttgtaaatgttgtatatggatgtattttgttggtaattatttttggtacttctaagatgtatatttattaaacagatttttacagtatcaaaaaaaaaaaa

SEQ ID NO: 2182 - DNA, 534 bp, Rattus norvegicus
  Genbank Accession No. X65228
ccttttttcgccaagatggcgccgaaagcgaagaaggaagctcctgcccctcccaaagccgaagccaaagcgaaggccttgaaagctaagaaggcagtgctgaaaggtgtccacagtcacaaaaagaagaagatccgaacgtcacccactttccggcggcccaagaccctgcggctccggaggcagccaaaatatcctcgaaagagtgcacccaggagaaacaagcttgaccactatgctatcatcaaattcccactgaccaccgagtcagctatgaagaaaatagaggacaacaacacgcttgtgttcattgtggatgttaaggccaacaagcaccagatcaaacaggccgtgaaaaaactctatgatatagatgtggccaaagtcaatactctgatacggcctgacggagagaagaaggcatatgttcgcttggctcctgattatgatgctctagatgttgccaacaagattgggatcatctaaagtgagtccagatggttaattctaaatatatactttttttccaccata

SEQ ID NO: 2183 - DNA, 2141 bp, Rattus norvegicus
  Genbank Accession No. X65296
ccacaatgcgcctctaccctctggtctggctttttcttgctgcgtgcacagcttgggggtacccatcctcaccacctgtggtgaacactgttaaaggcaaagtcctggggaagtatgtcaatttggaaggatttgcacagcctgtggctgttttcctgggaatccccttcgccaagccccctcttggctccttgaggtttgctccaccacagcctgcagagccttggaactttgtgaagaatactacctcctacccacctatgtgctctcaagatgctgttggagggcaggttctctcagagcttttcaccaacaggaaggaaaacattcctttacagttttctgaagactgcctctacctgaacgtttatactcccgctgacttgacaaagaacagccggctaccagtgatggtgtggatccatggaggtggactggtagtgggtggagcatccacctatgatggacaggtcctctctgcccatgaaaatgtggtggtggtgaccattcagtatcgccttggcatctggggattcttcagcacaggggatgaacacagccagggcaactggggtcacttggaccaggtggctgcactacactgggtccaggacaacattgccaactttgggggtaacccaggctctgtgaccatctttggagaatctgcaggaggtttcagtgtctctgctcttgtgttatctcctctggccaagaacctcttccacagggccatttctgagagtggtgtggtcctcacttctgctctgattacaacagatagcaagcccattgctaatctgattgctactctttctgggtgtaaaaccaccacatcagctgttatggttcattgcctgcgccagaagacagaggatgaactcctggagacttcattaaaattgaatcttttcaaactggacttacttggaaacccaaaagagagctatcccttcctacctactgtgattgacggagtggtgctgccaaagacaccagaagagatcctggctgagaagagtttcaacacagtcccctacatagtgggcatcaacaagcaagagtttggctggatcattccaacgcttatgggctatccactctccgaaggcaaactggaccagaaaacagccaaatccctcttgtggaagtcctacccaacactgaaaatctctgagaaaatgattccagtggttgctgagaagtacttcggagggacagatgaccctgccaaaaggaaagacctgttccaggacttggttgcagatgtgatgtttggtgtcccatcagtaatggtgtctcgaagtcacagagatgctggagcccccaccttcatgtatgaatttgagtatcgcccaagctttgtatcagccatgaggcccaagacagtgatcggagaccatggtgatgaactcttctcagtatttggatctccatttttaaaagatggtgcctcagaagaggagaccaatctcagcaaaatggtgatgaaatactgggccaactttgctcggaatgggaaccctaatgggggagggctgccccattggccagaatatgaccagaaggaagggtacctgaagattggtgcctcaactcaggcagcccagaggctgaaggacaaagaagtggctttttggtctgagctcagggccaaggaggcagcagaggaaccatcccactggaaacatgttgagctctgatcaggagggtcagccatgtttgagaacctggagctaaaggggaattattccacagaagattttgtaaagacataacacttcttgtctttgagactataacatcacatggtattttgtacaaatgcattaaagggaaaatacttaaccttattgcttcaacttgtaaaataaaacagactgaattttgcatggtgttctttgaagcggccacttgttgacaatttcatggatgccccagagagcccaagctctgcgttcaactcacctccaggagtaatatcctacgtcagcgttgacagtcagtcgagcgatgtcgaatgtctcgatgacattactgtcccacttctttcggtattctatgtcgtgcaggacatcgtagagcgtctcagctggtacgtcacagcattccatcctgcacttgatcttgtgcagagttcg

SEQ ID NO: 2184 - DNA, 864 bp, Rattus norvegicus
  Genbank Accession No. X68782
ctgcaggagtcaggcactgagcttgtgagacctgggtcctcagtcaagatttcttgcaaggcttctggctacacctttacagattactatatgcactgggtgaagcagaggcctgaacagggactggtatggataggacggattaatcctgcaaatggtaatactgaatatgcagagaagttcaaaagcagggccacactgactgcagataaatcgtccaacacagcctacatgcaactcagcagcctgacatctgaagacaccgcaacctatttttgtaccatttggggtacagtggtcccttttgattactggggccaaggagtcatggtcacagtctcctcagagagtcagtcctccccaactgtcttgcccctcgtctcctgcgagagccccctgtctgatgagaatttggtggccatgggctgcctggcccgggacttcctgcccagctccatttccttctcctggaactaccagaacaacactgaagtcatgcagggtgtcagaaccttcccaacactgaggacaggggacaaatacacagctacctcgcaggtgttactgtccgccaaaaatgtccttgaaggttcagatgaatacttggtatgcaaaatccaccatggcaacaaaaacaaagatctgcatgtgccgattccagctgtcgttgagatgaaccccaatgtgagtgtgttcattccaccacgtgatgccttctctggccctgcaccccgcaagtccagactcatctgcgaggccaccaacttcagtcccaaacagatcacagtatcctggctacaggatgggaagcctgtgaaatctggcttcaccacagagccagtgactgtcgaggccaaaggatcc

SEQ ID NO: 2185 - DNA, 2217 bp, Rattus norvegicus
  Genbank Accession No. X70369
tgcccccggagagaaaggtgaaggaggccctcctggtgccgcaggaccccctggtggttctggacctgctggtcctcctgggcctcaaggtgtaaagggtgaacggggcagtcctggcggtcctggtgctgctggctttcccggtggccgtggtcttcctggtcctcccggcaacaatggtaatccagggcccccaggacccagtggtgctcctggcaaggatggccctccaggtcctgcaggtaacagtggttctcctggaaaccctggagtagctggaccaaaaggtgatgctggccaaccaggagagaaggggccacctggtgctcagggtcctccaggatctccaggtccacttggaattgcagggctaactggagcacgaggtcttgctggaccaccaggcatgccaggtccacggggtagccctggacctcagggtatcaagggtgaaagtggaaagccaggagccagtggccataatggggaacgtggtcctcctggaccccaaggtcttcctggtcagcctggtacagctggtgagcccggaagggatggaaaccctggatcagatggtcagccaggtcgagacggatctcctggtggcaagggtgatcgtggtgaaaatggttctcctggtgccccaggcgctcctggtcatccaggaccacctggtcctgttggtccatctggaaaaaatggtgacagaggagaaacgggtcctgctggtccttctggtgctccaggtcctgctggagctcggggtgctcctggtccccaaggtccacgaggtgacaaaggtgaaactggtgaacgtggctctaatggcatcaaaggacatcgaggattccctggcaatccaggtcccccaggttctcccggtgctgctggacaccagggtgcagttggtagtccaggccctgcaggtcccagaggcccagttggtccacatggacctcctggaaaagatggatcaagtggacatccaggtcccattggaccaccagggcctcgaggtaacagaggtgaaagaggatctgagggctcgcccggtcaccctggacagccaggaccccctggaccccctggtgcccctggtccctgctgtggtggcggtgctgccattgctggagttggaggtgaaaagtctggcggcttttcaccatattacggggatgatccaatggatttcaagatcaacactgaggagatcatgtcttcactcaagtctgttaacggacaaatagagagtcttatcagccctgatggttctagaaaaaaccctgctcggaattgcagagacctgaaattctgccaccctgaactcaagagtggagaatactgggttgatcctaaccaaggctgcaagatggatgctataaaagtgttctgtaatatggaaaccggagaaacatgcataaatgccagtcccatgactgtcccgcggaagcactggtggacagatgctggtgctgagaagaaacatgtttggtttggagaatctatgaatggtggctttcagttcagctatggcaatcctgatcttcctgaagatgtccttgatgtacagctggccttcctcagacttctttccagccgggcctcccagaacattacataccactgcaaaaacagcattgcctacatggatcaggccaatggcaatgtaaagaagtctctgaagctgatgggatccaatgagggagaattcaaggctgaaggaaatagcaaattcacttacacagttctagaggatggctgcactaaacacactggtgaatggagcaagacagtctttgaatatcaaacacgcaaggccatgagactccccatcatagatatcgcaccctatgacattggtggtcctgatcaagaatttggtgtggacattggccctgtttgctttttataagccaaactctctgaaaccccagcaaaacaaaaaccacatccatgtgttcctcttgctttaatctcgtcaaccagtgaaagtgaccaactaaattccagttatttatttccaaacttttggaaaaagcataatttgacaaaaatagaatacaatttttttgctgtttcacccaccaatacagttcaaatgcttttgttttatttttttaccaattccaacttcataatgtctcaatggtgctataataaataaacatcaacacttttatgataaaaaaaaaaaaaaaaaaaaaaaaaaaaaaaaaa

SEQ ID NO: 2186 - DNA, 1959 bp, Rattus norvegicus
  Genbank Accession No. X70706
ccacctataatttattccacctctggcaaaggactgcaaaggcagccaggaaggagattcatcttcacatggacgagatggcaaccactcagatttccaaagatgagcttgatgaactcaaagaggcctttgcaaaagttgatctcaacagcaatggattcatttgcgactatgaacttcatgagcttttcaaggaagcgaatatgccattgcccggatataaagtgagagaaattattcaaaaactcatgctggatggcgacagaaataaagatgggaagataagctttaatgaatttgtttatattttccaagaggtaaagagcagtgacattgctaaaaccttccgcaaagccatcaacaggaaagaagggatttgtgctctgggaggaacttcagagttgtccagtgaaggaacccagcattcctactcagaggaagaaaaatatgctttcgttaattggataaataaagctttggaaaatgatcccgattgcagacatgtcatacccatgaacccaaatactgatgacctattcaaagcagttggtgatggaattgtgctctgcaaaatgatcaacctttctgttcccgatacaattgatgagagagcaatcaataagaagaagcttacacccttcatcattcaggaaaacttgaacttggccctgaattctgcttctgccattggatgtcacgttgtgaacattggtgccgaagatctgcgtgccgggaaacctcatctggtcttgggactgctctggcagattattaagattggcttatttgctgacattgaattaagcaggaatgaagcactggcggctttgcttcgagatggtgagactctggaggagcttatgaaattgtctccagaagagcttctgctgagatgggccaacttccatctggaaaactcaggctggcaaaagatcaacaacttcagtgctgacatcaaggattccaaagcctatttccatctactcaatcaaattgcaccgaaaggacagaaggaaggggaaccacggatagatattaacatgtcaggtttcaacgaaacagatgatttaaagagagccgaaagtatgcttcagcaagcagataaattaggctgcagacagttcgttaccccggctgatgttgtgagcggaaaccccaaactgaacttggcctttgtagccaacctctttaataaatatccagcactaactaaacctgagaaccaggatattgattggactcttctagaaggagaaactcgtgaagaaagaacctttcgtaactggatgaactctcttggtgtgaatccccatgtcaaccatctctatgttgacctgcaggatgccctggtgatcttacagctgtatgagagaattaaagttcctgtggactggagtaaagttaacaagcctccatacccaaagctgggtgccaacatgaaaaagttagaaaactgcaactatgcagttgaattagggaagaatcaggctaaattctccttggttggcattggaggacaagacttgaatgatgggaacccaaccttgaccttggctgtagtctggcagctgatgagaagatatacccttaatgttatggaagatcttggagagggtcagaaagcaactgatgacatcattgtaaactgggtcaatggaacattgagtgaagctggaaagtcaacttctattcagagttttaaggacaagacgatcagctccagtttggcagttgtggatttaattgatgccatccagccaggctgcattaactatgaccttgtgaagactggaaatctaacagaagaagacaagcacaataacgccaagtatgcagtgtcgatggctagaagaataggagccagagtgtatgctctccctgaagaccttgtggaagtaaaaccgaagatggtcatgaccgtgtttgcctgtttgatgggcaggggaatgaagagtgtaa

SEQ ID NO: 2187 - DNA, 1454 bp, Rattus norvegicus
  Genbank Accession No. X75207
ccgtcgacggccattaccaatcgcgaaaccggcgcagtagcagagagctgcagactccgcgcgctccggagaccggtcgtagagcgcgaggcagcgtcagcagcagacaccggagcccaacccggaccacagccctccccaggcggccgcgcatggaacaccagctcctgtgctgcgaagtggagaccatccgccgcgcgtaccctgacaccaatctcctcaacgaccgggtgctgcgagccatgcttaagactgaggagacctgcgcgccctccgtttcttacttcaagtgcgtgcagagggagattgtgccatccatgcggaaaatcgtggccacctggatgctagaggtctgcgaggagcagaagtgcgaagaggaggtcttcccgctggccatgaactacctggaccggttcttgtctctggagcccctgaagaagagccgcctgcagcttctgggggccacctgcatgttcgtggcctctaagatgaaggagaccattcccctgactgccgagaagttgtgcatctacactgacaactctatccgccccgaggagttgctgcaaatggaactgcttctggtgaacaagctcaaatggaacctggccgccatgactccccacgatttcatcgaacacttcctctccaaaatgccagaggcggatgagaacaagcagatcatccgcaaacatgcacagacctttgtggccctctgtgccacagatgtgaagttcatttccaacccaccctccatggtggctgctgggagtgtggtggccgcgatgcagggcctgaacctgggcagccccaacaacttcctctcctgctaccgcacaacgcactttctttccagagtcatcaagtgtgacccggactgcctccgtgcctgccaggaacagattgaagcccttctggagtcaagcctgcgccaggcccagcagaacatcgatcccaaggccaccgaggaggaaggggaagtggaggaagaagctggtctggcttgcacacccaccgacgtccgagatgtggacatctgagggccaccggcaggcgggagtcaccaagtagtggcatcgcgaagagaaaggagccagcccgggtgctcctgacgaggtccccttgggatgtgttgttaccagaaggggaagttttgttctctttgttggttgtttttccttaatctttctcctttctatctgatttaagcaaaagagaaaaaaaatacctgaaagctgtcttaaagagagagagagagatagaattcgcatcaccctgagtatagggagacgggggggtgctacaaaaatagaattctgtaccccagtaatcaactagttttctattaatgtgcttgtctgttctaagaataggattaacacacaggaagtcttgagaaggatttttgattcttttatgtgtttaagaaaaaaaagcttaagaaacattgcttt

SEQ ID NO: 2188 - DNA, 3551 bp, Rattus norvegicus
  Genbank Accession No. X76456
gtgtcctctgtctctgtctctgtctctgtctctgtctctgtctctgtctctgtctctgtctctgtctctgtctctctctctctctctctctgtgtgtgtgtgtgtgtgtgtgtgtgtgtgccttagagtctcttagactggctggcctgagagtcacagggaactacctagctacacttctcagtactgggatgagaggtgtgcattagaatgcctgcgttttacacgagctctggagactaaactcaaatcttcctacttgccaggcaagcagttaatgtcattatactgcatttccattttgatgtgttagctagtcatttctcttttaacatttggagtattttataactttggaggtagggctattcttaccctgtgaactgcttttcctctctctctctctctctctctctctctctctctctctctctctctctctctctctctcaagtcaagagattcccccctccgcatcattttcccctagttaataattaccaagaaatttgcaccaagaccaaaaaaagcctatgtatttcagaaatagattaactaggttactttttaacaaagcttaggtcaaagaatactataaaacgttggttttgccccagtcgcattactctcttgaatgtggcctcttttttaaatttaaacatgagacacttaaaacttacaggttttatttttttcctgttgtctttgactgaatccctagccctacccacaaagcctcaggatgtaggtaagaaatttacttgtgtattaccagggacaactaagtgaaggaaattactttcctttagccttttaaaactttgattattccggtggttttatttttctctctcttctcttagtatatgtatactggtcagtagtttcaaaggacccactacagattttcatattatctattctgtaggatgcttgcctttagaaacggccaacaatctggatcatgttgacttgagatgtaatttggacttcaaaaatattagaattttgtgacagatatagatatataaatatatgtatagtccaacagaagagcatagatacagtatatacatattcatacatatacatacatacacacatatgtacacactcacacacaaacacatgtataaacatttatatacaatctttaaaaaatattttttaaatatttttggttgtccaatatgtcttccagctagatgataaataccgtcaggtatatgagatcctgctttctccttcagctggcgttacacacctgcaacatactacgccaagagcaaggcgtgtcaaccgggtggaaaaggcaatttttacattttaccaaatgaggaaactttgaaattttctttgaaagaaaagaaaattttctttgaaaggtctttttaaatacctctggccagaaaggcacattttttttttacaggaatgtagtttccttaatatcatcccagagaacatatactcaagtgatattatacagactgataaggttgtatctatgtatcagagaatgtaaaaatttataatatatataacatcaatcaatcaattaatgaaaaagaggccatgcatttgaaagagagcaaggaggggttaacaggagaacaggcaggggatcatttcaatgctactcagaaattcataaatgagaacgttgcatacctgaccatcattgcatctgcccagtatgttcaggaagcatcctttgaggaggtggaaatgctggtgaaggtcatgctggattacaaggataggtgcttggctgacagcacacttccggagtgttcaaagatagctaatgatgctatccaggacatgctctgtgatatgaaggggctgccacagaagcataacttctcccattgctgtaggcaagccggctttcaaagaagactctgcttcttctacaacaagaaagctaatgtaggatttctgccccctttccctactctggatccagaagagaaatgccaagcttataaaaataacagtgaatcttttctcaacctctatatgtatgaggtggccagaaggaacccctttgccttcgccccagttcttctgaacgttgccgctaggtttgaggaggcggcgaccacgtgctgtgaacagcaacagaaagccacctactttcaagacaaggcagcccccatcacacagtatttaaaagcgttatcttcttatcaaagaaatgtttgtggagcccttttaaaatttggacccaagaccttaaactctataaacatcgccgtgtttagtaagaagttccccaagattggatttgaagaccttacgtccctcttagaagatgtttcttccatgtatgacgggtgctgtgaaggggacgtcgtgcagtgcatccggagccagagccaggttatgcaccatatttgttcaaaacaagactccatctcaagtaagatcaaagcgtgctgtgagaagaaactgccagagcgcgcagactgcataatcaacgcaaacaaggatgacagaccagaagacttatctctgagaacacccaaatttaccgacagtgaaaatgtgtgccaagagcgagattccgagcaggacaagttctttgctgagtttctttatgattactccagaagacatactgaactgtctacaccagagctcctaagaattactaaagtgtataaggatctcctggaagattgctgcaacagaaaaaacccgttaagctgttaccgccatgcggaggataagttcaacgagacaacagagcgaagccttgcgatggtccagcaagagtgcaaacagttccaggaattggggaaggacgctctacaacgccatttccttgtcaagttcaccaaggcagcccctcaactccccatggaagaactggtctcccttagtaaggaaatggtggcggctttggcaacctgctgcactctcagtgacgagttcgcctgtgtggacaacttggcagatttagttcttggagaattatgtggaatgaataagaatcgaactatcaatcccactgtggatcactgctgcagagctgactttgccttcaggagaccctgctttgagcacctgaaagccgacaccacctatgcactcccatcagtctctgcacttgtatctgctttgcgtgcagactggtgtcagcctctcaaggaggaccttcagaataagagacacaggtttctggtcaacttagtgaagtggatgccagagatcacagatgaggaacgtctgtgtttgttcacaaagttcacggctgctggggaggagtgtggcaacatacagaagcctgaggcctgtttcagtccagagagttcaaaaaccggtgatgtgagtcaagatgcagagaaacaaaggtgaacggaatgaccagagccagtaccagctcacaggatcgtcctgtggagaagttcagctcttaagaagactggaatagaaggtccttctgtaaccctttcttgaatcatgttcctacaaaaggcaataaaaagggaggataaagtttctcgcggcgcgaaaaaaaaaaaaaaaaaaaaaaaaaaaaaaaa

SEQ ID NO: 2189 - DNA, 678 bp, Rattus norvegicus
  Genbank Accession No. X76489
atgccggtcaaaggaggtagcaagtgcatcaaatacctgctctttggatttaacttcatcttctggctcgccggcatcgcagtgcttgccattggactatggctgcggttcgactctcagaccaagagcatcttcgagcaagaaactaatcattccagcttctacacaggagtgtacattctgattggagctggggccctcatgatgctagttggtttcctgggctgctgtggagctgtacaagagtcacagtgcatgctgggattgttcttcggattcctcttggtgatattcgccattgagatcgccgcagccgtctggggctatacccacaaggacgaggtgattaaagaactccaggagttttacaaggacacctaccaaaagttaaggaacaaggatgagccccagcgggaaacactcaaagccatccatatggcgttgaactgctgtggcatagctggtggtgtggagcagtttatctcggacatctgccccaaaaagcaggttctggaatccttccaggttaagtcctgcccggatgccatcgatgaggtcttccacagcaagttccacatcattggagcagtgggcatcggtatcgccgtggtgatgatcttcggtatgattttcagcatgattctgtgctgcgccatccgcaggagccgagaaatggtc

SEQ ID NO: 2190 - DNA, 1838 bp, Rattus norvegicus
  Genbank Accession No. X78949
gaattccgcgggattccgccttcctcacggcccgctatccaggtgtgtgaacctgtggggtgctccaagatgatctggggtgtattaatgatggggattctacttcctcagtgttcagcccatccaggcttttttacttcaattggtcagatgactgacttgatccataatgagaaagacctggtgacgtcactaaaagattacattaaagcagaagaggacaagttagagcaaatcaaaaaatgggcagagaagttagaccggctaacaagtacagcaacaaaagatccagaagggtttgtcggacaccctgtaaatgcattcaagttaatgaaacgtctgaacaccgagtggagtgagttggagaatctgatcctcaaggatatgtcagatggcttcatctctaacctgaccattcagaggcagtacttccctaacgacgaagaccaggttggggctgcaaaagctttgtttcgtctgcaagacacctacaacctagacacgaataccatctcgaagggcaatcttccaggagtgaaacacaagtcttttctaacagctgaggactgctttgagttgggcaaagtggcctatacagaagcagattattaccacacagaactctggatggagcaggctctgatgcagctggaggagggagagatgtctactgtagacaaagtctcggttctagattatttgagctatgcagtgtaccagcagggtgacctggataaggcacttctgcttacaaagaaacttcttgaactagatcctgaacaccagagagccaatggtaacttagtatattttgagtatataatgagtaaagaaaaagatgccaataagtctgcttcgggtgagcgggctgatcagaaaactacaccaaagaaaaaggggattgctgtggactacctgccagagagacagaagtacgaaatgctgtgccgtggggagggtatcaaaatgactcctcggagacaaaaaaggctgttctgccgctaccatgatggaaaccggaatcctaaatttatcctggccccagccaagcaggaggatgagtgggacaagcctcgcatcattcgtttccatgacatcatctcagatgccgagattgagatcgtcaaagatttagcaaagcccaggctgagccgagctacagtacatgaccctgagactgggaaattgaccacagcacagtacagagtatctaagagtgcttggctgtctggctatgaagatcctgtggtgtctcgaattaatatgagaatacaagatctcacaggactggatgtttccacggcagaggaattacaggtagcaaattatggagttggaggacagtatgaaccccattttgactttgccaggaaagacgagccggatgcttttagagagcttgggacaggaaataggattgccacgtggctcttctacatgagtgatgtgtctgctggaggcgctactgtttttcctgaagtgggagccagtgtttggcccaaaaaaggcactgctgtcttctggtacaatctgtttgccagtggagaaggagattacagtacacggcacgcagcctgtcctgtgctagtgggaaacaaatgggtatccaacaaatggctccatgaacgtggacaggaatttcgaaggccgtgtaccctgtcagaattggaatgacaaccaggcttcccgtggctcctctcgtcctctaacgcaccaggcatgatcgctgactgtaacattcagaagtttacagctgactaacactccatgattaattcggccgtgaaccccatcccatgtttcatctgtggacaatcacttatttttgtgaatttttt

SEQ ID NO: 2191 - DNA, 443 bp, Rattus norvegicus
  Genbank Accession No. X81448
caagatcatcgaagacctgagggctcagatctttgcgaattctgtggacaatgcccgcatcgtcttgcagatcgacaatgcccgtcttgccgctgatgactttagagtcaagtatgagacggaactggccatgcgccagtctgtggagagtgacattcatggactccgcaaggtggtggatgacaccaacatcacgaggttgcagctggagacagaaatcgaagcgctcaaggaggagctgctgttcatgaagaagaatcatgaggaggaagtccaaggcctggaagctcagattgccagttctgggttgactgtggaagtggatgctcccaaatctcaggacctcagcaagatcatggcggacatccgtgcccagtatgaacagctggctcagaagaaccgtgaggaactggacaagtactggtctcagcagattgaggaga

SEQ ID NO: 2192 - DNA, 767 bp, Rattus norvegicus
  Genbank Accession No. X81449
caagatccgcgactggtaccagaagcagggacccgggcccttccgtgattacagccagtacttcaagaccatcgaggacttgcgcgacaacatccttggcgccaccattgagaactccaagatagtcctacagatcgacaatgcccgcctggctgcagatgacttgcggaccaagtttgagacagaacagggcctgcgcatgagtgtggaggctgatatcaatggcctgcgccgggtgctggatgagctgaccctggccaggaccgacctggagatgcagatagagaacctgaaggaggagctggcctacctgaagaagaaccacgaggaggaaattagtgccctgaggagccaggtgggtggccaggtcagtgtggaggtggattccacaccaggcattgaccatgccaagatcctgagtgagatgagaagtcagtatgaggccatggcagagatggaccggaaggatgctgaagcctggttactcaagattgatgagacgttgaacacccaggtcgctgtccacactacgcagatccagataaacaagactgaggtcacggaactcgaacgtaaggtccaggaccttgagattgaattgcagtctcagctcagcatgaaagctgccctggaaggcactgtggcagagatagaggcccgctacggagcccagctgtcacacatccaaggtgtgatcagcagtattgaagtccagctgagtaacgtgcgtgctgacacagagcgccagaaccaccagtatcagcagg

SEQ ID NO: 2193 - DNA, 463 bp, Rattus norvegicus
  Genbank Accession No. X89696
catctgcaagcccttgcactacatgaccatcatgagccgacctgtgtgtatattcctagtgggtgctgctgtaatcttaggattcatccatggagcaatacaaactttatttatggcccagttacccttctgtggtcccaatatcatcaaccattttatgtgtgacttaataccactcctggagttggcctgcactgacacacacactctggggcccctgatcgctgccaacagtgggtcactgtgtttgcttactttctctatgctggttgtttcctatgtggtcatccctcgctccctgaggaatcacagttcagaagggcgtcgcaaagctctgtctacctgtgcctctcatgtcactgttgttgtcttattccttgtaccttgttcttacctgtacctaaggcccatgacctccttccccactaacaaagctgtaactgtgttttgcaccctagtgaca

SEQ ID NO: 2194 - DNA, 347 bp, Rattus norvegicus
  Genbank Accession No. X90642
aaggttggtattgtgggtcgtacaggagctgggaaatcatctctcaccctgggtttgttccggatcaatgagtctgcagaaggggagatcatcattgatggcatcaacatcgccaagattggcctgcacaacctgcgcttcaagatcaccatcattccacaggatcctgttttgttctcgggttccctccgcatgaacctggaccctttcagtcagtattctgatgaagaagtctggatggctctggagcttgctcacctgaagggctttgtgtcagccttgcctgacaagctgaaccatgagtgtgcagaaggtggagagaatctgagtgtggggcagcgacagct

SEQ ID NO: 2195 - DNA, 1758 bp, Rattus norvegicus
  Genbank Accession No. X96437
gaatagcgtctcgggagtgtccctgggtaatcgctgcatctcgttttgtgtgtgtgctctgtcgaaacgtctgtgatgtgtgtatggttttcacgtgaacggaggcaggcagagttgggtctgtgggttctagtgtgttcttaatctttttggaagtttgtgcagtgacttcccctctgggattgtttcctatgcataccttcaagtatgtgtgaatgtgttttctgtggtcccttgatcttactgggcttctctaaggagggtggctggaccatctgctacgtgtctgggagcccctctctagctaccacatgtcccgacatgtgcttactcccaatatttgcacccactcgcattcacaactcccaggcaaaaagaaaaaatcaaaaaaacaaaaaaaacgtgcactggggcacctagaaaatgggcagccaaggctccgcctacattttgcttcctccttggaatttccagccctgtgcagccaactgctccctagctgcgaagggcggagtttcccggctctataagtagtggtgccttaccggggatccgcactcctccgtaccctctgtacagcgcgcgaattatgtgccattcgcgtaaccacctccacaccatgactggcctgagggctccggcgccagttccctccaccggcccggaactccggcggggctccggtcccggaattttcaccttcgaccccctcccggagcgggcggtagcgtccgccgtgcgtccgaacacttctcgcgggcacggaaaacgcagccgacgggtgctctaccctcgagtggtgagtatcgcccgagtgggcagcaagaggtcgagtcgccccggaacctttgggaacaactagatgcggggactttcgtctgacgtttccctcttttctctgctcaggtccggcgccagctaccaaccgaggaacccaacattgccaagaggatcctctttctcctgctcgccatcatcttctgccagattttgatggctgaagaaggtgtgtcgcaggccctggctccggaggatgctaccagcgccatatcacctgagcccatctctgcgcccattactgcgcctcctgtcctcgagcctttgaacctgacctcggagtcctcggactatgctctggatctcaaagcttttctccagcaacacccggcggcattctaaacgcgatgggtcacagtccggaaaaaaaaacccaaagagcaccaggggtacctggtcggcaagaacgtatcccaaactgggacttataaggcaacgctaactcagaacactaccgccaagatgccggttcttggggcgagcccgaggcaccgtgggtcctggctaggctcactggtgacggacggaggtcttctccgtgtctaattaatatttatgtatttatgtatatcctcctaggtgaaggaggggtgtatgtaatatttattctaacttatgcaggggtgcgagatatgcccccttgctgtgacacagatatttattacgatttatagggtccgtgagacagagttgtgggaggattagtttagtcttggtcggggggcataggtttaggggtaacactccattttccagcacttcgactctgttgtaagactttggcagacccttgggaatacggtctgtgtgcctttgatgtcttcctgactggaagtcttgggtccatggattgtcagagggcggctgtctggggtcgcctagtatgttctgtgaacacgaataaacttgatttgcctgtcg

SEQ ID NO: 2196 - DNA, 1341 bp, Rattus norvegicus
  Genbank Accession No. X98490
gcggattcgaaagcttcagcagctcctcctatggcgcagcgggcggctacacgcagtcccccggtggcttcgggtcacccacaccgtcgcaggcagagaagaaatcaagagcccgagcccagcacattgtgccctgtaccatatctcagctgctctctgctactctgactgatgaggtgttcaaaattggggatgtcgagatttcacaggtcactattgtgggaataatcagacatgcagagaaagcgccaaccaacattgtctacaaaatagacgacatgaccgcagcgcccatggacgttcgccagtgggttgacacagatgataccagtggcgagaacactgtggttcctccagaaacatacgtgaaagttgctggccacctcaggtcttttcagaacaaaaagagcctggtggcctttaagatcattcctctggaggatatgaatgagttcacggcgcacattctggaagtggtcaattcacacttgatgctcagcaaagccaacagccaggcctctgtagggagaccatctatgagcaacccaggaatgggtgagccaggaaacttcagtgggaataacttcatgccagcaaatggcctcaccgtggtccaaaaccaggtgctgaatttgattaaggcttgcccaagacctgaaggattgaacttccaggatctcaggagccagctccagcacatgcctgtagcctcaatcaaacaagcagtggattttctatgcaacgagggccacatttactctacagtggatgatgatcactttaaatccacggacgcagagtaacgagctctgggaactggcatcccagcgggcctgtcatcatctatctgttcttcccagctctgcaggttttggacagaagttccctgtagaaggtctcagctgaagtccttttggaacgcattgctctttgttttgtcacttattgtttagaggttcaaaaggagataggcagttgagaaagaagtaaactgagcaggatttcttaagagaaattccgataagctagtcaggactccagatggatggtgggaatggaaggaggaccagcagagcagagcagaaccacgtcatgcttgggagcctctgttcttgaaaggcttccgtcgagaacgaaccatactagggccaagggcccaagaagaacctaccttccttccccttgtcctgcctgcagttgaaagaaggtttaaatgagcctgaggttctgtgcaaaggcctcatggggcagacaggaagaaatgttactgtgtttgtaatataaatgttcatatgtttgataaaacagttcacttgtaaaaaaaaaaaaaaaaaaaaaaaa

SEQ ID NO: 2197 - DNA, 3628 bp, Rattus norvegicus
  Genbank Accession No. Y07704
tggggatgctagtgcctactgcgctggctgctcggctgctgagcctgttccagcaacagctgggttccctctggagtggcctggccatgctgttctgctggctgagaatagcattggggtggccagatcctggaaagggacagccacgggtccggggtgagcccaaggagactcaggagacccacgaagatccaggcagtgctcagcccacaacccccgttagtgtcaactaccacttcacgcgtcagtgcaactacaaatgtggcttctgcttccacacggccaagacatccttcgtgctgcccctggaggaggccaagcgaggactgcttctgctcaaacaggctggtatggagaagatcaacttttcaggaggagaacccttcctacaggacaggggtgaatacttgggcaagctcgtgagattctgcaaggaggagctagccctgccctctgtgagcatagtgagcaatggcagccttatccgagagagatggttcaaggactatggagactatttggacattcttgctatctcctgtgacagctttgatgagcaggttaatgttctcattggtcgtggccaagggaaaaagaaccatgtggaaaaccttcaaaagctgcggaagtggtgcagggattacaaggtggctttcaagatcaattccgtcattaatcgcttcaacgtggacgaagatatgaatgagcacatcaaggcgctgagccctgtccgctggaaggttttccaatgcctcctgattgagggtgagaactcaggagaagatgccctgagggaagcagaaagatttcttataagcaatgaagaatttgaagcattcttacagcgtcacaaagatgtgtcctgcttggtgcctgaatctaaccagaagatgaaagactcctaccttatcctggatgaatatatgcgctttttgaactgtaccggtggccggaaggacccttccaggtccatcctggatgttggcgtggaggaagcgatcaaattcagtgggtttgatgagaagatgtttctgaagcgcggggggaagtatgtatggagtaaggctgacctgaagctagactggtgaggtgagattggacggagactctaaccagctacgaggagtccacgagcagccgctcgccaccacgcacatctggctgtctacggactgttgctactgagaatgcactctatgttctttctttcagtttgactgaactaagaaaggagtaaaaccattctgtgaacccttatacagccgataagggtcctccacaggggaaggagttcagttcacagaggaacaaggtccagcgatctcaaagaactcacattttatttgtattcgaatttttgtatggatcgttactgtgaatcccatgtttccttttccctttctgttcccccatgagaaactgggttattttctgctaactatgccagttttgtcaacaggaaggatcacaaaacacaccctgcgattactgctgactgttctaatgcttttctgctttggaatctcggactttttgctcagaaatatagaatcaagaagtgtgttatagagccgtacgtgagaaccttactcttttgcaaggagcatatggaaggaggtacttctgaggacggtgtgttcatggcctcagcctctgctgctgctgctgcttcaaggatggctgttctatatcgtaccaattccttcaaggttctggacaaagccaaggtacactttacctttcatggcatggccgtgaagatggcactgacagccgcaaccaccccagcactgaggctgcctgagtctgtcaggctaaaaggttgtcccacttttctgaaaagctacaagggctcttctgcacatccagcagaatcatgacaggatgggcatggaggactcttcaggagtatgaaatgtggctgctgctccttaccatatttctcatgaaactctgaaataagacctagtagtctaggtcaccatgagaaaataatttcttctctacatcaaataagcaaaagagagaacatgaactagcccaaatcttcttcctgtggaagcattgcatgagtttattcaacctagacagcctcactgcttggaaaataattccctggaaattaaataaataccatggaaaagaaattaaactcctctgcaatcccactgtggccactagagggcaccaggaagtcagacttcattgtctcagagacttttcttcagtctttttttagaatttggtgaattttaattctgttccttatctgttttgtctttgttttttgttttggtgcctattactaaaattaatactaaacattttccaaggaactggaattttggccatttacaaaaggtcttcattctttagtgaggtcactataattcaactaagacatactctgtctcattaaaaataggtcaggttttcctgtgttttctgtcttgtttggttgtgtgtgtgtgtttacctatttttgcttgaatatagatataactatgtatcccaggctagcctggaactcatgatacctctgccttaacctccccctcttaagtgcccaggaattacccaactcctgtacagagatttttaagagaagtttgagtcacattcccccctgcagattgtgatttttttttttaagttaagtcctgtgtacatagttcacatgggaaaccatgacatcccagaggacatgggcagacacccacttggtcacacgacagagggaagctgcatgtttctttccctaattaaagtagagcatgaagaaagtatgattggaaagtgagccatcatttacatgtacccccaaccccttgtgcatgcactggcggtgggagatctctgtgcttaaaatattgaaaagtcccctttccttaaagggaaaaattacgatattttactatcgtagtacaaatcaaacttggattagatcatacattggtttgctttttcagtgttaaatktgggtgttcattttgtaaagcatacgctccctgctggggaaacaaggagtgatctagttgacatttgttaagtgtgaccagcagataccttgtgtcccatgattgatttatgcagagcagtaatactgggaagggggatttacttaagaacatcgacgggtaggacatccaacactgatttcaaagttttggcttctttattataatgtgttcggcggtaaaaaaaagtcatgggttgttttctttgaagctgaaagtctcatggtgttatttacctaaattatctgaaaaatttaaaaggggcccaggtttcattctgcgttggagtttgggggtctaattgttgcataaataaacaggcaaccaatcatcagaggttgactcctcccatcaataattcagctcgtgttttacccttttgatggactgatgttgtttcataagctattagtagtccaagaacaatcatgcaggcctcatgtgaatgtgttcagatgaggtttgatgttcgggatacatgtgcatgtatctccctgtagaatgacactgtattttgaggcattgctctagtgtatggaaacgtgatctgtgtattaaaatgttttatgcatgacctcaaaaaaaaaaaaaaaaaaaaaaaaaaaaaaaga

SEQ ID NO: 2198 - DNA, 1662 bp, Rattus norvegicus
  Genbank Accession No. Y08355
cattcagtttagtcagaatccatgggtgggctcagctgtctcctccgtacctagtctgcggttatggcttcgctcacggtgaaggcctatctactgggcaaggaggaggcggcccgcgagatccgccgcttcagcttctgcttcagcccggagccggaggcggaagccgcggctggcccggggccctgcgagaggctgctgagccgggtggctgtgctgttccccgcgctgcggcctggaggctttcaggcgcactaccgcgatgaggatggggacttggtcgccttctccagtgatgaggaactgacaatggccatgtcctatgtgaaagatgacatcttccgcatctacattaaagagaagaaggagtgccggcgggaacatcgccccccatgtgctcaggaggcacgaagcatggtgcaccccaacgtgatttgtgatggttgcaatgggcctgtggtgggaactcgctataagtgcagtgtgtgccccgactacgacctgtgcagcgtctgcgaggggaagggcctgcacagggagcacagcaagctcatctttcccaacccctttggccacctctctgatagcttctctcatagccgctggcttcggaagctgaaacatgggcactttggctggcctggctgggagatgggcccaccagggaactggagcccacgtcctcctcgcgcaggggatggtcgcccttgccccacagctgagtcggcttctgctccatcagaggatcccaatgtcaatttcctgaagaatgtgggggagagcgtggcagctgccctcagccctctaggcatcgaggttgacattgatgtggaacatggagggaagagaagccgcctgacacccacctctgcagaaagttccagcacaggcacagaagataagagtggtactcagccaagcagctgctcttcggaagtcagcaaacctgacggggccggggagggccctgctcagtctctgacagagcagatgaagaagatagccttggagtcggtgggacagccagaggaactgatggagtcggataactgctcaggaggggatgacgactggacgcatttgtcttctaaagaagtggacccatccacaggtgaactccagtctctacagatgccagaatcggaagggccaagctctctagacccctcacaggaaggccccacagggctgaaggaagctgccctgtacccacatctcccaccagaggctgatccccggctgattgagtcactctctcagatgctgtccatgggtttctcggatgaaggcggctggctcaccaggctcctacagaccaagaattatgacatcggggctgctctggacacgatccagtattcaaagcaccctccaccattgtgacagtgctgtggccaagtcccacaacccacctcccttgtcttctagttgcatcatgtagagtagcagggcttctaaggcccagtgtcttggcattcttctagaaccttcaggtgggactgtgaggccttcttaggcagtaggaaagtgcatgagaagagagtctgagtgtgcacatgctgacccctgagcacagatccaagcagctgtggctgggcttmcgctgctttccctcggcctggcctttgccagggagctgtggagtcatgctgcactccactt

SEQ ID NO: 2199 - DNA, 2597 bp, Rattus norvegicus
  Genbank Accession No. Y09945
gcgaaaaagaacttgttaaatcctttgggctcacataagagcaatttatttttgtgccttcctttggacatagtaattagtcctagatggcctttcaggacctcctgaatcaagttggcagcctggggaggttccagatccttcagatgactttcattttgatcttcaacataataatttctcctcattctctattggagaacttcacagcagtcattcccaatcatcgctgctgggtccccatcctcgacaatgacactgtctctggtaatgacaatgggaacctgagccaagatgacctcctgagggtctctatccccctggactccgatctgagaccagagaagtgtcgtcgctttgtccaaccacagtgggatctccttcatctaaacggtaccttttccagtgtgacagagccagacacagagccctgtgtggatggctgggtgtatgaccaaagcacctttctttccaccattattaccgagtgggacctggtgtgtgaatctcagtcactggattcaatagctaagtttctattcttgactggtatcttagtaggaaatatcctatatggccccttaacagacaggtttgggaggaggttaatccttatatgtgcctcactgcaaatggccgtcactgaaacctgtgcagcttttgctcccacctttctcatctactgctcactacgattcctggcagggatttccttctcaaccgttttgaccaatagtgccttgctcattatagaatggacaaggcctaaattccaagccttggcaacaggactgctattatgtgctggagcaattggacagacagtattggcaggcctggcttttactgtgcgaaactggcaccacctccatctggcaatgtctgtaccaatatttttcttacttgtacccacaaggtggctgtcagagtcagcgcggtggctgattatgaccaacaaactccagaagggcttaaaagaacttataaaagttgcacacataaatggaatgaagaattcaacagatgtcctaaccattgaggttgtgagaacaatcatgaaggaggagctggaggcctcacagacaaaatcttccctgtgggacttgttccgtacacctaacttgcgtaagcggatatgccttctgtcccttgtgagatttgtggtatggttatctgtgattggtttactgatcaacttccagcacctaaggatcaatgtcttcctattgcagtgtcttcttggtataatcaccattccagccaatttagttggaatttttttggtgaatcacttgggtcgcagaataagtcaactatttatcatatccctgtttggaatttccattttggccataatatttgtgcctcaagaaatgcagatcctgcgcatggttttggcaacttttggaggagtattttcttttgtctctgttagcagtgctcttgtgcatgcaaatgagctacttcccactataatcagggcaactgctttaggagtcattggaattgctggtagtactggggcagccctgtctcctctgtttatgatccttaggacatactctgactccttgccctggatcatctatggagtcctttccttccttggtggccttgttgtccttctcctccctgagaccaagaatcagcctctgcctgactccatacaggatgtggaaaatgaaggaagagcctccagacaaggaaagcagaatgatactctcatcaaagtgacacagttttaagagactccaagagctgaaatctgataaaggagcaagataagaaaactgtcactcagatttatgatggcccaggttcactctagatacagcaaaattccttatcaagtaacgatatagcaaaaattttgtattacatttaaaatttccacattcaactgatacttaaattatctcaataacaaaattaaaggaaaacaacacagtgaaataaatcttcagagttttaatagacacttatgaagtttccacaaaggatgtggatgaaccttcttcccattattgtgacataatgcttgggaaaattaaaaatggataatttattgtgaaattcccattagtttcatcccactgctgttgcgataatctcctgtgtactatgtagatgaccgtctttgtattattcaagtgctgatctcagtatcagcagagatttaagtatagctggactttggtattattatttttatgaagcatcaccagtctcagtattctgtaaacatcttctctatcaccttctgattggtataataaaaaggcgaatggcctatgccagggcaggagaggaaaggtagatatttcatttgttgagagatagaaactctgggaaagagttgatgatgaaattgatcagcgaaatgtgctagaagcctcagaattttgtaaaaaacaccatgttaacagtaaagatttgaagaaagatttttctaacaagcccaagttctgggcaacaagcccagaaaattataaggaaatgtcctacttgttctttgtataacctaacaccatcacttgcagaaagtaacccaaagatacccaaagaaataaaattttacaagtgtaaaaagagagaga

SEQ ID NO: 2200 - DNA, 1182 bp, Rattus norvegicus
  Genbank Accession No. Y13275
acttgcctgaagataacgtttgggatatttaaaggtgtgggttaattttttatccattttagtaactgggttttttttttttctttccgactacttccttgctttctattgctacccgaagctgcaggcacacggatctctgcaggcaaaatccctcagagccttcgcaggacagcctggtaacgactggttcgtcctactgtaactgggtggctgccccttctccgaaatggcaggtgtcagtggctgtttaaagtattcgatgtttttcttcaacttcttgttctgggtatgtggtacactgatcctgggtctagccatatggttgagagtaagcaaagacggcaaagagattatcacatccggtgacaatggcacgaaccccttcattgctgtgaatatcttgattgcagttgggtccatcatcatggttctgggtttcctgggatgctgcggagctgtgaaagaaagtcgctgcatgcttctcttgttttttatcggcttgctcctgattctgcttctgcaagtagccgcaggtatcctaggagctactttcaaatctgaatctagccgcattctgaatgaaacgctctatgaaaatgccaagcttttgtcagaaacaagcaatgaggcaaaagaagtacagaaggccatgattgcatttcagtcagagtttaagtgctgtggcttgagatttggagctgctgactggggaaaaaattttccagatgcgaaagagtcatgccaatgtacaggatctgattgtgaaagttataatggagagaatgtctatcgaacgacctgtctttctctgataaaagagctggttgaaaaaaacattattattgtcattggaattgcctttggactggcagttatcgagattcttggtttggtgttttctatggtgctctactgccaaattggaagcaaatgaatctgcggacttcctcagtcgttatagacaccatttaagtttttgctttggcttcgtaactttaaatactcgagtactgtacataccaggagcagatgtcttcttgatgagctctcacttaggcagactacaggtatcttcacatgtactcagctcatttaactgtgaaggacataataaaagtggtcgtgtatttttttttctcacaataaaaagtgttcgtgctgaaaaaaaaaaaaaaaaaa

SEQ ID NO: 2201 - DNA, 342 bp, Rattus norvegicus
  Genbank Accession No. Y13336
atgtcggcgtcggtagtgtccgtcatctcccggttcctggaggagtacttgagctccactccacagcggctgaagttgctggatgcctatctcctttatatattgctgaccggggcgctgcagttcggctactgtctcctcgtgggcaccttccccttcaactctttcctctctggcttcatctcttgtgtgggcagcttcatcttagcggtttgcttgagaatacagatcaacccccagaacaaggcggatttccaaggcatctctcctgagcgagcctttgctgattttctctttgccagcactatcctgcacctcgtcgtcatgaactttgttggctga

SEQ ID NO: 2202 - DNA, 1644 bp, Rattus norvegicus
  Genbank Accession No. Z11995
gcactacaaagagaagatccacgagtacaatgtactgctagatacactgagcagagctgaagaaggttatgagaaccttctcagcccctctgacatgacccacatcaagagtgacaccctggccagcaagcacagtgaactgaaggacagactgcgtagtatcaaccagggcctagaccgcctgaggaaggtcagccaccagggctacggccccgccactgagtttgaagagccccgagtgatagatctgtgggacctggctcagtctgccaacttcactgagaaggaactggagtcgttcagggaggagcttaagcacttcgaggccaaaatcgaaaagcacaaccactaccagaagcagctggagatttcccaccagaagctgaagcacgtggagagcatcggtgaccccgagcacatcagccgcaacaaggagaagtacgtcctgctggaggagaagacaaaggagctgggctacaaggtgaagaagcatctgcaggacctgtccagcagggtctcaagggctcggcacaatgagctctgagaccagaagccactggcagtagcctagagaggctcttgaagacactgggaactgtcaacttgtcatactggtgtggctgtccacagtggcaaggagaaataccgatctgatcctgctgcggctggcaaggactaattttctttcaagcaagtgtagctgtcaccgccctggttgagggctttgggtacatctaccaatgagatatgaccggtctccatgctgcagcaaaagtttacattgaaattatataaatctgtcgccgacagtttattgaaaggaaatcttgctttatccatgaagtcacttccatggaggtagctgtgataaagtgtctcttccccatgacaacgcatagcaccaatccctactgaaagacctgcccgagtacaccaactgtcctggtggaatgacactctggagcaggaaaaacaaatttctaaaaggcatacagtgattatcttctgagctttgcagctggcaacatgtatgttttcacacaagatatttttaagctagcgaaagaaaatactcaagcaggattagttcttaaagcaataaacaggggaataaaaacatcatgtatatataagaaaaccaaggcatgctcacaggtttgagccaagaaagacctggagccctaatccccaccttgtcccaggatgcacctgtcatgatcacagggaagagatgagtctgggatttacaaacctctctctaaacctcagtccagtgttgtgccgctggctgtaccacacacaccgcacaagccccgactgctcccattccattacggcacaggagacatgttctcaccctgcctagcctgctttggtggggggaggcggcggcagggaactctacaagtgtttccagtggtgacctctgttctccctttcaggagctgttttccttcatgtagctagccccatggctaccagaaagaactagaataggagctggctgattttgtcaaaccccaaaacaaacacccctttcctccgggtcttgattttgtcacctgaatctctgggacgagtggccaaggcatttctaggcttactgcaagtatcagatgacgacataagattctagaagtcaag

SEQ ID NO: 2203 - DNA, 1311 bp, Rattus norvegicus
  Genbank Accession No. Z12298
cggttttttttttttttcaacctagtgacagtcacagagcagcaccaccccctcctcctttccacacctgcaaactctcttgcttgggctgcattacttagtgttaattacatcgcagctttgagggctccggtggcaaatacccggattaaaaggtggtgaaaacgcatgagacaaccatgaaggcaactctcgtcttattccttctggcgcaagtctcttgggctggaccatttgagcagagaggattatttgacttcatgctagaagatgaggcctctggcataatcccttacgaccctgacaatcccctgatatctatgtgcccctaccgatgccaatgccatctccgagtggtgcagtgttctgatctgggtctggacaaagtaccctgggagtttccacctgacacaacattgctagacctgcaaaacaacaaaataacagagatcaaagagggggcctttaagaacctgaaggacttgcataccttgatccttgtcaacaacaagatcagcaagatcagcccagaggcatttaaacctctagtgaagttggaaaggctttatctgtctaagaaccacctaaaggagctgcccgaaaaattgcccaaaacactccaggagcttcgactccacgacaatgagatcaccaaactgaagaaatctgtgttcaatggactgaaccgtatgattgtcatagaactgggcggcaacccactgaaaaactctgggattgaaaatggagccttgcagggaatgaagggtctcggatacatccgcatctcagacaccaacataactgctattcctcaaggtctgcccacttctatcagtgaactgcatctggatggcaacaagatcgccaaagttgatgcagccagcctgaaaggaatgtctaatttgtctaagctgggtttgagcttcaatagcatcaccgttgtggaaaatggcagtctggctaatgttcctcatctgagggagctccacttggacaacaacaaactcctcagagtgcctgctgggctggcacagcataaatatgtccaggtcgtctaccttcataacaacaacatctccgaagttgggcagcatgacttctgcctcccttcataccagactaggaagacttcctacactgccgtgagtctttatagcaaccctgtccggtattggcaaattcacccacacaccttcagatgtgtcttcgggcgctctaccattcaacttgggaactacaagtaactcccaaacagcctcatttttataatcgggaacaaaaaaaccaatctgtcaatattattgctaaaaa

SEQ ID NO: 2204 - DNA, 1067 bp, Rattus norvegicus
  Genbank Accession No. Z49761
cgactcgctgagggtgttaaggtatggagcatgagcagaagtcaggagggctgctgaggctgctgcggcttctgtggctgctgcctcactcctgggcggtgcttgaagcttctccccaggcgtggtgggatgagtcgcagaaccacacattccgtcacactctgttctgccaggatgggtttcccaacatagggctctccgagacctacgacgaggacgcactcttctccttcgacttctcccagaacaccagagtgccccggctgcctgagtttgctgagtgggctcaggaacagggagatgcctctgccattgcgtttgacaaaggcttctgcgacatgttgatgcagaatgtgagcccgcggcttgaaggtcaaatcccagtgtccagaggtttgccttcggctgaggtgttcaccctgaagcccctggagtttggcaagcccaacacgctggtctgtttcatcagcaacctctttccaccgactttgacggtgacctggcagcatcatttcgtccccgtggagggagccagccccacgtccgtgtcagccatcgatgggctcaccttccaggccttctcttatttaaacttcacaccggagcccttcgacctttactcctgcactgtgacgcacgagattgaccgctacacggcaattgcctattgggtaccccagaacgccctgccttcagatctcctggagaatgtactgtgcggtgtggccttcggcctcggtgtgctgggcctcgtcgtgggcattgtcttcttcatccgctcccagagaccttgctcaggggactgattcttcccaaggagggcttggaacagcaccagccaggccggcagcgatgtccaggcatctcgcgcttaccagggtctttcctcagagccgaagtccccgggatcccttggggtgcatgccggcatgctaaggggttccgctgtccctggacttacatccagaaaagccggagtcaggagccccgggccccaccagaccactaccttataccttccctcatccaggaaataaagtttatttcttaaaaaaaaaaaaaaaaaa

SEQ ID NO: 2205 - DNA, 707 bp, Rattus norvegicus
  Genbank Accession No. Z75029
gctctgggtcggggcccaccatcgaggaggtggattagaggctctttctggcgctccaggtgtgatctaggagacagatgggtggccttgaggactttgggttattgtcgtttaggacattaactccttcgttcggtctgcaatcaagtcctaggtttaagcaaactgccttccatttactctgtggaatttcacgtgtgctttgcattcccagtaaattagtactgggagtgtgtctttgcaatagatataatttcctgccttcaagtcagcactgccccccccccgaagttatttctttgcaggacagtcagagctatattgatatagcaagaggtgtgttacaaaaacaccaggacactgttgagttcctttgtgtttggactctcccctgggcgacagtgttgaggcactgttaagtcaggagctcggggccaccggtggatcactgaaagctgagactctgttgcttctcccgtttgacactctgttgctttccttgcatggtggctcacctaaggctgagactcttgttctccttccctgtataatcttgcctggcgttgcacttgttccccagtgtgtgaactcggagatgagtttacaccaccactgttagttcacgttttttgtttttacataaccatcctgaactcaggtcaatttttagctggctatttgaaaataaacttcaaaagaacttgcca

SEQ ID NO: 2206 - DNA, 571 bp, Rattus norvegicus
  Genbank Accession No. AA964755
tttttttttttttttttaaatataaacttccatatgatttattgttgttccttgtacacaagaaacagtaatatacaagttacactgctttagaatgtaaaatggataaaatgtgtacaaaaaagcacgttcctagaacacagggcattggcaaatagtcaaacctgggaagtaaaaagcaaaaccaaaaacaaaaccaaagaaacaaactaaaacaaaacaagaaaaaccaacatttcttcaattcagtgtgcaacatataaaaaacagaaatactaactctacaggcagtatttcctgataaattatttaaatagcatatctacatagtctgagatctctattccaatggcaatgagaaaataatttataaaaataaaagcaatggtgtacaagatgatagaacaaaaccagaactttgaggagttgtatttaacatttcaaagctatttctgtattgggatcattctctgcaaaggatttttatgctatgtacaacactgactttttagacacgacagtagttttaagtttattgacacttaaactctttcttcttgattcaaaatcc

SEQ ID NO: 2207 - DNA, 273 bp, Rattus norvegicus
  Genbank Accession No. AA956638
tttttttttttttttttacctgcagaaaaaaatttattgagatctaaaatcttaacaagaaatagggaactttagaaaacatccacatggaattttatcttcctgcaatgttaatctaacaaaaaaaaaccccagaaaacaaaacagtctataaaactgtgctgtcctctctgcctgcagtaaatgttcagtttctacgagatacacctgcacactttggtaaagttacaagtcacaaaagaaaacaaaaaccaaccaaagaaaacatcttcc

SEQ ID NO: 2208 - DNA, 2285 bp, Rattus norvegicus
  Genbank Accession No. X73524
gcggccgcccttttcctggcaggacagagggatcctgcagctgtcaggggaggggcggcgaggggtgatgtcaggagggctacaaatagtgccgacagctaaggggctccgtctcccctcttatccactctccagccggctgcccgcctgctgcctcctctttgcgtccgctcagcctcgtccacgccgccaccatgagccaggcctactcgtccagccagcgcgtgtcctcctaccgccgcaccttcggcggcgccccgggcttctcgctcggttccccgctgagctctccggtgttcccacgagcaggcttcggtaccaagggctcctcgagctcagtgacatcccgcgtgtaccaggtgtcgcgcacgtcgggcggggccggaggcttggggtcgctgcgggctagccggctggggaccacccgagcaccatcctatggcgcgggcgagctgctggacttctcgctggccgacgcagtgaaccaggagttcctggccacgcgcaccaacgagaaggtggagctgcaagagctcaatgaccgcttcgccaactacttcgagaaggtgcgctttttggaacagcagaacgccgcgctcgccgccgaggtcaaccggctcaagggccgagagccgactcgggtcgccgagctctacgaggaggagatgcgagagctgcggcgccaagtggaggtcctcaccaaccagcgcgcccgcgtcgacgtggagcgtgacaacctgatagacgacctgcagaggctcaaggccaagctacaggaggaaatccaactgagagaagaagcagagaacaacttggctgccttccgagcggatgtggatgcagccactctggctcgaattgacctagagcgcagaattgagtcactcaacgaggagattgcattccttaagaaagtgcacgaagaggagatccgtgagctccaggcccagcttcaggaacagcaggtccaggtagagatggacatgtccaagccagacctcacagccgccctcagggacatccgtgctcagtatgagaccattgcggctaagaacatctctgaggctgaagaatggtacaagtccaaggtttcagacttgactcaggcagccaataagaacaacgatgcgctgcgccaagccaagcaggagatgatggaataccgacaccagatccagtcctacacctgcgagattgatgctctcaagggcaccaacgactccttgatgaggcagatgagggagctggaggatcgcttcgccagcgaggccagtggctatcaggacaacatcgcgcgcctggaggaggagatccgacacctaaaggatgagatggcccgccatctgcgggagtaccaggatctgctcaatgtgaagatggccttggatgtggagattgccacctaccggaagctgctggagggcgaggagagcaggatcaaccttccgatccagaccttctctgctctcaacttccgagaaaccagccctgagcaaaggggttccgaagtccacaccaaaaagacagtgatgatcaagaccattgagacccgggatggagaggtcgtcagcgaggccacacagcaacaacatgaagtgctgtaagccagacacgtgtcctggccccgtcctcactgcctcctgaagccagccttttccactctcggatgtcacacccagtcgcttttctcctctcacagcctctgaaccctcctcacaatcacctctttgtggtcttcatgctgcccagcctcaggaaacccctcagccacctctgcagaccctcccatgagccctggctattggcaactgtcaagcctggctcttaagagagaacctagctcaaggcctgacccttttccctgccatctttgtgacctctggcttagaagggggtaccagagagggcgatgggaccggcagggtcaggacagagctttgtggatatccccacattcgacccccagcctgggtcagagacagaatgaagcctcagcgagctgagatggagaagggggggcctgaaaaatgtcctcgtggcccctctctttcccaccccagctcagataggcttggaaagcaggggctgtaagagagaactggaaggtgctggatgtgggagcaggagatacagaaggagagaggatgggtgagaagttggagaggaaagaagagagaggcagagagtgggctcaggttggtgggaggatgccacctcccctgcctgcccctcccaccgcaggggccctggacagaaacaataaagagataagcacaaaaaaaaaa

SEQ ID NO: 2209 - DNA, 1758 bp, Rattus norvegicus
  Genbank Accession No. Z22607
gagagggtggtgctggagggtgggaaggcggcacgagcgaggcctggcccggaagctaggtgagttcggcatccgagctgagggaccctagtctaagactccgctgctacccagtctgagtatctggtctccgtccctaatgggattctcgtccaaaccgtctggagcctgcagcgatccagtctctggccctcgaccaggttcactgcagctgtctagaggtccccaggagcagctgctggcgagcccgcttctgcaggaacctatggagccattccgtagtgccattccgagcgacgcactgccgcagcttctctgagcctttccagcaagtttgttcaagattggctcccaagaatcatggactgttattatatgccttgttttctgtcaagacaccatgattcctggtaaccgaatgctgatggtcgttttattatgccaagtcctgctaggaggcgcgacagatgctagtttgatacctgagaccgggaagaaaaaagtcgccgagattcagggccacgcgggaggacgccgctcagggcagagccatgagctcctgcgggacttcgaggcgacacttctgcagatgtttgggctgcgccgccgtccgcagccgagcaagagcgccgtcatcccggattacatgagggatctttaccggctccagtctggggaggaggaggaagaagagcagagccagggaaccgggcttgagtaccctgagcgtcctgccagcagagccaacactgtgaggagtttccatcacgaagaacatctggagaacatcccagggaccagtgagagctctgcttttcgtttcttctttaacctcagcagcatcccagagaatgaggtgatctcctctgcagagctccggctatttcgggagcaggtggaccagggccctgactgggaacagggcttccaccgtataaacatttatgaggttatgaagcccccagcagaaatggtgcctggacacctcatcacacgactactggacaccagactagtccgtcacaatgtgacacggtgggaaactttcgatgtgagccctgcagtccttcgatggacccgggaaaagcaacccaactatgggctggccattgaggtgactcacctccaccagacacggacccaccagggccaacatgtcaggattagccgatcgttacctcaagggagtggaaattgggcccaactccggcccctcctggtcacttttggccacgatggccggggtcataccttgacccgccggagggccaagcgtagtcccaagcatcacccacagcgctccaggaagaagaataagaactgccgtcgccattcgctctacgtggacttcagtgacgtgggctggaatgattggatcgtggccccaccaggctaccaggccttctactgccacggggactgtccctttccactggcggaccacctcaactcaaccaatcatgccattgtgcagaccctggtcaactccgttaattctagcatccctaaggcctgctgtgtccccaccgaactgagcgccatttccatgttgtatctggacgagtacgacaaggtggtgttgaaaaattatcaggagatggtggtggaggggtgcggatgccgctgaaatcaggcagtccggaggacggatgcacacacacacacacacacaaagcccatccgaccacccacacataccacacaaagtgcttccctatagctggacttttacttaaaaaaaaaaaaaaaaaactcgag

SEQ ID NO: 2210 - DNA, 450 bp, Rattus norvegicus
  Genbank Accession No. AI071965
tttttttttttttttttggcaagttcttttgaagtttattttcaaatagccagtaaaaattgacctgagttcaggatggttatgtaaaaacaaaaaacgtgaactaacagtggtggtgtaaactcatctccgagttcacacactggggaccaagtgcaacggccaggcaagattatacagggaaggagaacaagagtctcagccttcggtgagccaccatgcaaggaaagcaacagagtgtcaaacgggagaagcaacagagtctcagctttcagtgatccaccggtggcccctgagctcctgacttaacagtgcctcaacactgtcgcccaggggagagtccaaacacaaaggaactcaacagtgtcctggtgtttttgtaacacacctcttgctatatcaatatagctctgactgtcctgcaaaagaaataacttcagagggggggca

SEQ ID NO: 2211 - DNA, 4344 bp, Rattus norvegicus; identical to SEQ ID NO: 1812
  Genbank Accession No. U32681

SEQ ID NO: 2212 - DNA, 606 bp, Rattus norvegicus
  Genbank Accession No. AA892041
gaacctcacacagcagaatttagaaatggcaacccactcctttaggacatttagtggcaaacaatgtcactgcctgtctttcataaggcgagttcacattcacagatcactagagagcagacctggaaactccaggaagtacatgtgctgtcttccacacattcttggaagcccactttgatagaaactcaccatggatttcctatagagaactctccccccccccccacctcccctgctttatttactgaaagtacagaattgaaagtttctccccactttatggttctccacaatgggtaacagaagattcagtttggaaacctacaaaagatgtttatcattctagcatggagcccacactgacactaccttgctgatcacagaccctgcagagaccctgcagtcaccaacacataattcgtttcaaagaaagccagtcagcagggcgctgtgatggatggaggggcagaatgctggcgaaggcacagagtaaagaatcccgagaatgttttggtgccatttccatttaaggagccagtagtatagcgagcgacctacgcgacttcggctgtgaccacgccacaatctttctacggaactgca

SEQ ID NO: 2213 - DNA, 533 bp, Rattus norvegicus
  Genbank Accession No. AI232320
ccttctttccttttaatcgccatattaaaagtttagatccaaaattttagaaattctcgggaaactttaagaaacgagcatgaactatgatagcccacagtctgataataagctgcaacaaacgggcggttgccaggctggggggaaggtctgtatccctgcaggtcagcggctcccctttctttctccctttccacaggggggctctggtccacagcaaaacctggggggctcactgcttcagggagggtcacccaggatccacagagggaggcccttcaccgcagagcagatcctatggggtcgctgggtctattcaccgttcactgctgtgggtggaattttaaggggaagccgtttgggtaacggctctgctcacattttttccccggggaatggttgaatggattggcctccttagacgggacgccgggcatattttctgcggggcatctaatccactcgttcaaggtaccaagggcctgggaagaggttgcttgtgtcaccagggggagagaagttcaccttgtggt

SEQ ID NO: 2214 - DNA, 1733 bp, Rattus norvegicus
  Genbank Accession No. M26125
gacttgggaggaaccagggcctacacttagccctggtaaacagcagagcatgctgggataattcttcccagaaaaggaaaagcaggcacttctgttcccagggaaaacaacaggagcactttggacctccctgctgcagtcaggagtcatgtggctggaacttgtcctggcttcccttctgggctttgtcatctactggtttgtctcccgggacaaggaggaaaccttaccactaggagatggatggtgggggccagggtcaaagccatcagccaaagaagatgagagcatccggcccttcaaggtggaaacatcagatgaggagatcaaggacttacaccagaggatagataggttccgggcatccccacctttggagggcagccgcttccactatggcttcaactccaactacatgaagaaagtggtgtcctactggaggaacgagtttgactggaggaagcaggtggagatcctcaaccagtaccctcacttcaagaccaagatcgaagggcttgacatccacttcatccatgtgaagcctccccagctgccctcagggcgcaccccaaagcccttgctgatggtgcatggctggcctggatccttctatgagttttacaagatcatcccactactgactgaccccaagtcccacggtctgagtgacgagcacgtgtttgaagtcatctgtccctcgattcctggctatggctactcagaggcatccagcaagaaaggtttaaattcggtggccactgcgaggattttctacaagctgatgacacggctgggcttccagaaattctacattcaaggcggggactgggggtccctcatctgcaccaacatggcccagatggttcccaaccacgtgaaaggcctgcacttaaatatggctttcatttcgagaagtttttacaccatgactcctctcctgggccaacgcttcgggagattccttggctacacagagaaggatatcgagctcttgtacccctataaggagaaggttttctacagcatcatgagggagagtggctacttacacatccaagccaccaagccagacactgtgggctgtgctctcaatgactctcccgtgggcctggctgcctacatcttagagaagttctccacctggaccaagtcagagtaccgtgaactggaggatggaggcctggagaggaagttctccctggatgatctgctggttaacatcatgatctactggacgacaggaaccattgtctcctcccaacgctactacaaggagaatttgggccagggcatcatggtccataaacatgaggggatgaaggtctttgtgcccactggcttttcagccttcccttccgagctactgcatgccccagaaaagtgggtgaaggtcaagtaccccaaactcatctcctattcctacatggaacgtgggggccactttgctgcctttgaagagcccaagcttctggcccaggacatccgcaagttcgtgtccctggctgagctgcagtagtgacactggataccaactgtggctttagcagcagccctggttcctcccaagtcacacttatggaagatgacccctttctgaggaataagtttgttccctgaccacactcgaggacccagacttaaactccacagagtcgtatgttacccccatatgcttcacctcactacatagctgtgttagctacatggctttaatgataaatggatttatttct

SEQ ID NO: 2215 - DNA, 905 bp, Rattus norvegicus
  Genbank Accession No. M30689
ctcttgctctcctccagccacaagtggtctcagaagatgctagaatgtagaggaaacagaagatgaactggcaggttttgcctgtgcgccccttctcagaggatgaacagatcttgtgctatgaagtcctgtgtgctcatccttctcctggccctactgtgtgcagaaagagctcaggggctaaactgctacaattgcacgatgatcccatttggtaatacctgctcatcaactgctacctgcccctaccctgatggagtctgcactattcaggtggcagaagttgttgtgagctctgtaagactgaaagtaaagagcaatctctgccttcccggctgccccaagagtcctcaaacacctgaggtcctcggtaccgttgtccatgtgaatactgactgttgcaatacagatctttgcaacgcagcaggtcccactggaggcagcacgtggaccatggcaggggtgcttctgttcatcctgggctcagtcctcctgcagaccttgctgtgatggaccctccaaggccctgccacccttgtccttttatccttatgtgtaatcactccttcctggagccctctagtgataaattctgagtaataaaaattcagaggggggattgagtgtggaacaccttgttgcaactctatagccactgctggataggttccccactcccctctctagggctttcagatatgtacttcctagaatgccattgtgttttggtttgctgctcttggccctggaggcaggggacagcacggggaagaggcagaaacccaaggcactgtgacaccacctccatccatacataaaaatctggggttctgcagggttcccacacatgcctctgaacatccccctatttgagtccaataaactctctgttctcccacggaatt

SEQ ID NO: 2216 - DNA, 590 bp, Rattus norvegicus
  Genbank Accession No. AI177125
gcatcaatcgacctttaatgtccaaaagaggcgtggatgcagagcatagatgtggcagggtctcagtccctgcacagaaatgagagatgaacaaaaacgagacacttccacctggccagagtctgggagggcagggaggaacacagacctggacattcgtaagaaaaataaaacctaaatcaaacattcaatcttgtacccaataaaggtttgaacagggaactcagtcaccaccagttcccaccctcccctgccagcactgaagaaaaacaaaagttcaacacacactaagggcttaggaggaaggggcattctcctgccttcccccaacccccaagaatgggctggggaaaaaacggctatatttccccaccccttacagtgtcaaccctacacgagttctgaatgtgatccgtaagaatcagcagctcaattggcaaggacaacccccacccaccccaatcacttcaccaacagacaagatttcccttgcacttctctccggaatctcctcattcccagcccttttccacctcctcactcccagaggtcattacacacttcagacctgttccaaggagcccctcccc

SEQ ID NO: 2217 - DNA, 305 bp, Rattus norvegicus
  Genbank Accession No. AI072161
tttttttttttttttggtgttaggaattaacccagggtcacccataggttagccatgtggtctagcactgacccacatccccagtcatgagtcattttcttaacaaaattcagaacactagtaatctgctgtggcacccaggaacttgagagactgaggcgtaaggttaccatgagaaagaaattcaacaacaaattttattacaaggggggaatataagttaatcgtggttttttgggtttttttgttttaagagtgttgatccaaaaattaaactgactcttactcaccctcgtgccgaattc

SEQ ID NO: 2218 - DNA, 302 bp, Rattus norvegicus
  Genbank Accession No. H32189
atactgggatactggaacgtccgcgggctgacacacccgatccgcctgctcctggaatacacagactcaagctatgaggagaagagatacgccatggggacgctcccgactatgacagaagccagtggctgantgagaagttcaaactgggcctggacttccccaatgtggagagacagaggaggagcggattcgtgcagacattgtggagaaccaggtcatggacaaccgcatgcagctcatcatgctttgttacaaccccgactttgagaagcagaagccagagttcttgaagaccatcc

SEQ ID NO: 2219 - DNA, 381 bp, Rattus norvegicus
  Genbank Accession No. AI170906
ctagcttcaaagtggctgtcaatgagggcctggagctccatgaggtccttgttctgacgcttcttctggatatcatcgaagtctactttctctccttccgggatcttaggagcagtaagtttgggtcttggtttctcctctactcatgacagccagcatgggaagaggaagaaaaagagatcaggtaaggtaggatgaacctccctgccacaggcttctactcagcccacccaggccaccctccttctcagaagcaccatgcctatgaaatcccctaagggctctaggaaggacttagggtgcgggcatgaaggcaagaacgggaaaaaccacaagacatgtgtgtccctagagggatgggagggagggaagcctcgtgcc

SEQ ID NO: 2220 - DNA, 596 bp, Rattus norvegicus
  Genbank Accession No. AI177143
tcatctctttattaaggagctatgctctggagcggttgtttacactcggagtttctgcatttacactcagggctcatttcaaatgggcgaggccatggctttcctgaagaacagcagaggatggacgtaccaaccgacatctgagatgaacacagcaagcataggagcagtgcaaggagaatacaataaatatggcacctacttgaaaaagcagcatagagcaaagacctagaaatcccaggtgatcacaagcgggcttcaaaatgaaagcaaggccacttgccaggacgaacagttagtgaaaatgttgcaataagatttcaagtattaattctctagattatttgatggccttaatttgtacaaactacagacacaggactaaatttgacatcatccttaaactcactggcacaacactcccaggtttaaggaagccggcagcctggacagtacattgcactcttcagctaatgtgcttttccaatatttggcccagactcttccctgacaacatttacgaaatgctcaaaggaaccttctggaagtaaaccagaagacacgcaaaccattgttacaaaagcagaaagaaaaat

SEQ ID NO: 2221 - DNA, 58 bp, Rattus norvegicus
  Genbank Accession No. M22922
acacgtggtaccatgtggctccagatcctgttcctcgtcctgtccgtgggacgaattg
